United States Patent
Weiss et al.

(10) Patent No.: US 11,028,171 B2
(45) Date of Patent: Jun. 8, 2021

(54) BISPECIFIC ANTIBODY CONSTRUCTS FOR CDH3 AND CD3

(71) Applicant: AMGEN RESEARCH (MUNICH) GMBH, Munich (DE)

(72) Inventors: Bertram Weiss, Berlin (DE); Ann-Lena Frisk, Berlin (DE); Ruprecht Zierz, Berlin (DE); Peter Kufer, Munich (DE); Tobias Raum, Munich (DE); Doris Rau, Munich (DE); Jonas Anlahr, Munich (DE); Ralf Lutterbüse, Munich (DE); Lisa Nahrwold, Munich (DE); Christoph Dahlhoff, Munich (DE); Claudia Blümel, Munich (DE); Patrick Hoffmann, Munich (DE)

(73) Assignee: AMGEN RESEARCH (MUNICH) GMBH, Munich (DE)

( * ) Notice: Subject to any disclaimer, the term of this patent is extended or adjusted under 35 U.S.C. 154(b) by 148 days.

(21) Appl. No.: 15/566,444

(22) PCT Filed: Apr. 18, 2016

(86) PCT No.: PCT/EP2016/058482
§ 371 (c)(1),
(2) Date: Jan. 3, 2018

(87) PCT Pub. No.: WO2016/166360
PCT Pub. Date: Oct. 20, 2016

(65) Prior Publication Data
US 2018/0142021 A1 May 24, 2018

(30) Foreign Application Priority Data

Apr. 17, 2015 (EP) .................................. 15164154

(51) Int. Cl.
| | | |
|---|---|---|
| *C07K 16/00* | (2006.01) | |
| *C07K 16/28* | (2006.01) | |
| *A61P 35/00* | (2006.01) | |
| *C07K 16/30* | (2006.01) | |
| *A61K 39/00* | (2006.01) | |

(52) U.S. Cl.
CPC .......... *C07K 16/2809* (2013.01); *A61P 35/00* (2018.01); *C07K 16/28* (2013.01); *C07K 16/3053* (2013.01); *A61K 2039/505* (2013.01); *C07K 2317/31* (2013.01); *C07K 2317/33* (2013.01); *C07K 2317/56* (2013.01); *C07K 2317/565* (2013.01); *C07K 2317/622* (2013.01); *C07K 2317/73* (2013.01); *C07K 2317/732* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | |
|---|---|---|
| 3,691,016 A | 9/1972 | Patel et al. |
| 3,773,919 A | 11/1973 | Boswell et al. |
| 3,969,287 A | 7/1976 | Jaworek et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,301,144 A | 11/1981 | Iwashita et al. |
| 4,330,440 A | 5/1982 | Ayers et al. |
| 4,439,196 A | 3/1984 | Higuchi |
| 4,447,224 A | 5/1984 | DeCant, Jr. et al. |
| 4,447,233 A | 5/1984 | Mayfield |
| 4,475,196 A | 10/1984 | La Zor |
| 4,485,045 A | 11/1984 | Regen |
| 4,486,194 A | 12/1984 | Ferrara |
| 4,487,603 A | 12/1984 | Harris |
| 4,496,689 A | 1/1985 | Mitra |
| 4,544,545 A | 10/1985 | Ryan et al. |
| 4,596,556 A | 6/1986 | Morrow et al. |
| 4,640,835 A | 2/1987 | Shimizu et al. |
| 4,670,417 A | 6/1987 | Iwasaki et al. |
| 4,751,180 A | 6/1988 | Cousens et al. |
| 4,790,824 A | 12/1988 | Morrow et al. |
| 4,791,192 A | 12/1988 | Nakagawa et al. |
| 4,816,397 A | 3/1989 | Boss et al. |
| 4,816,567 A | 3/1989 | Cabilly et al. |
| 4,935,233 A | 6/1990 | Bell et al. |
| 4,941,880 A | 7/1990 | Burns |
| 4,946,778 A | 8/1990 | Ladner et al. |

(Continued)

FOREIGN PATENT DOCUMENTS

| | | |
|---|---|---|
| EP | 0 036 676 A1 | 9/1981 |
| EP | 0 058 481 A1 | 8/1982 |

(Continued)

OTHER PUBLICATIONS

U.S. Appl. No. 07/466,008, Kucherlapati et al.

(Continued)

*Primary Examiner* — Meera Natarajan
(74) *Attorney, Agent, or Firm* — Marshall, Gerstein & Borun LLP

(57) ABSTRACT

The present invention relates to a bispecific antibody construct comprising a first human binding domain which binds to human CDH3 on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

14 Claims, 21 Drawing Sheets

Figure 1:
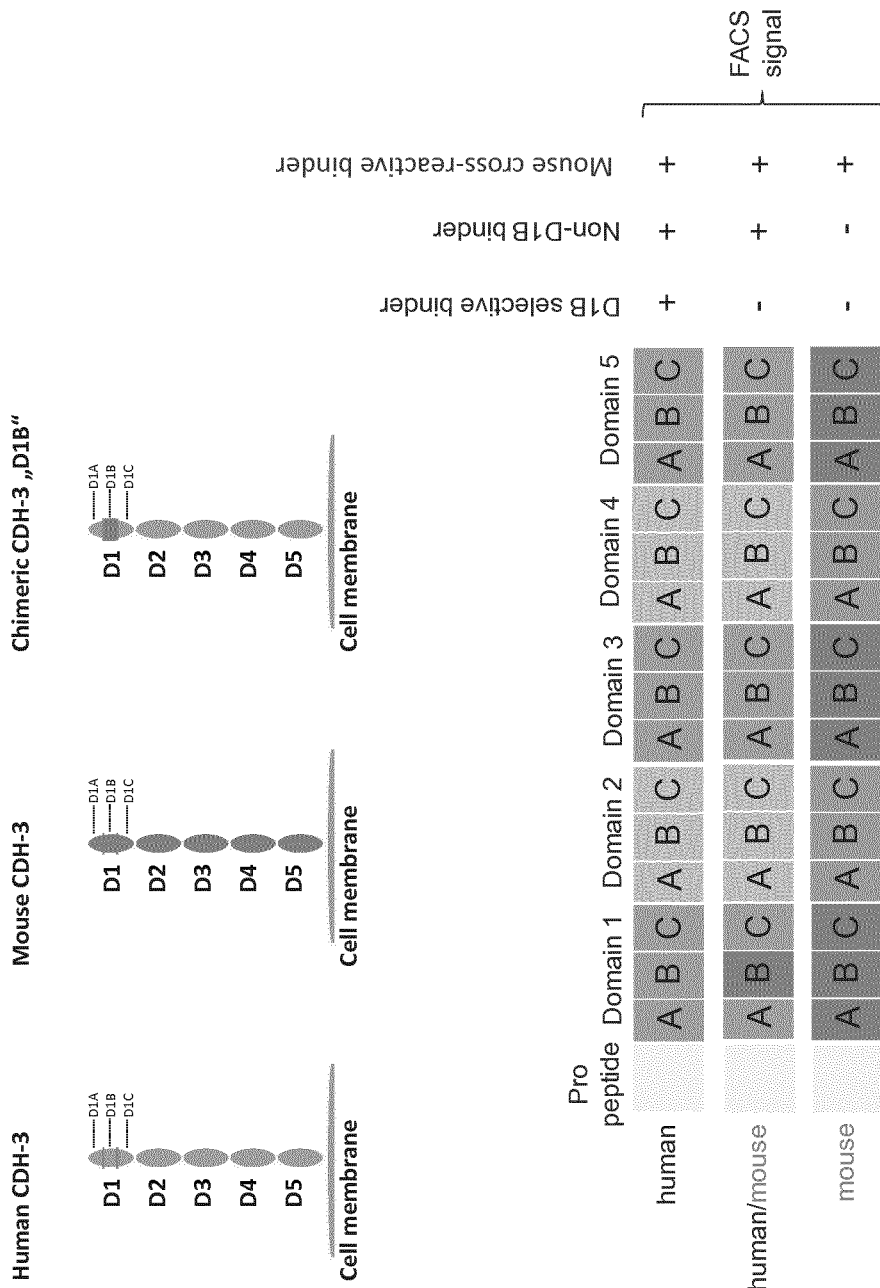

Specification includes a Sequence Listing.

(56) References Cited

U.S. PATENT DOCUMENTS

| | | | |
|---|---|---|---|
| 5,013,556 | A | 5/1991 | Woodle et al. |
| 5,064,413 | A | 11/1991 | McKinnon et al. |
| 5,223,409 | A | 6/1993 | Ladner et al. |
| 5,225,539 | A | 7/1993 | Winter |
| 5,292,658 | A | 3/1994 | Cormier et al. |
| 5,312,335 | A | 5/1994 | McKinnon et al. |
| 5,383,851 | A | 1/1995 | McKinnon, Jr. et al. |
| 5,399,163 | A | 3/1995 | Peterson et al. |
| 5,418,155 | A | 5/1995 | Cormier et al. |
| 5,476,996 | A | 12/1995 | Wilson et al. |
| 5,545,806 | A | 8/1996 | Lonberg et al. |
| 5,545,807 | A | 8/1996 | Surani et al. |
| 5,565,332 | A | 10/1996 | Hoogenboom et al. |
| 5,569,825 | A | 10/1996 | Lonberg et al. |
| 5,585,089 | A | 12/1996 | Queen et al. |
| 5,591,669 | A | 1/1997 | Krimpenfort et al. |
| 5,612,205 | A | 3/1997 | Kay et al. |
| 5,625,126 | A | 4/1997 | Lonberg et al. |
| 5,625,825 | A | 4/1997 | Rostoker et al. |
| 5,633,425 | A | 5/1997 | Lonberg et al. |
| 5,643,763 | A | 7/1997 | Dunn et al. |
| 5,648,260 | A | 7/1997 | Winter et al. |
| 5,661,016 | A | 8/1997 | Lonberg et al. |
| 5,683,888 | A | 11/1997 | Campbell |
| 5,693,761 | A | 12/1997 | Queen et al. |
| 5,693,762 | A | 12/1997 | Queen et al. |
| 5,698,767 | A | 12/1997 | Wilson et al. |
| 5,721,367 | A | 2/1998 | Kay et al. |
| 5,741,668 | A | 4/1998 | Ward et al. |
| 5,770,429 | A | 6/1998 | Lonberg et al. |
| 5,777,079 | A | 7/1998 | Tsien et al. |
| 5,789,215 | A | 8/1998 | Berns et al. |
| 5,789,650 | A | 8/1998 | Lonberg et al. |
| 5,804,387 | A | 9/1998 | Cormack et al. |
| 5,814,318 | A | 9/1998 | Lonberg et al. |
| 5,859,205 | A | 1/1999 | Adair et al. |
| 5,874,299 | A | 2/1999 | Lonberg et al. |
| 5,874,304 | A | 2/1999 | Zolotukhin et al. |
| 5,876,995 | A | 3/1999 | Bryan |
| 5,877,397 | A | 3/1999 | Lonberg et al. |
| 5,925,558 | A | 7/1999 | Tsien et al. |
| 5,939,598 | A | 8/1999 | Kucherlapati et al. |
| 5,958,765 | A | 9/1999 | Brams et al. |
| 5,981,175 | A | 11/1999 | Loring et al. |
| 6,023,010 | A | 2/2000 | Krimpenfort et al. |
| 6,075,181 | A | 6/2000 | Kucherlapati et al. |
| 6,114,598 | A | 9/2000 | Kucherlapati et al. |
| 6,150,584 | A | 11/2000 | Kucherlapati et al. |
| 6,162,963 | A | 12/2000 | Kucherlapati et al. |
| 6,255,458 | B1 | 7/2001 | Lonberg et al. |
| 6,300,064 | B1 | 10/2001 | Knappik et al. |
| 6,407,213 | B1 | 6/2002 | Carter et al. |
| 6,673,986 | B1 | 1/2004 | Kucherlapati et al. |
| 2003/0070185 | A1 | 4/2003 | Jakobovits et al. |
| 2006/0240001 | A1 | 10/2006 | Bauer et al. |
| 2014/0221620 | A1 | 8/2014 | Zhang et al. |
| 2014/0302037 | A1 | 10/2014 | Borges et al. |
| 2014/0308285 | A1 | 10/2014 | Yan et al. |

FOREIGN PATENT DOCUMENTS

| | | |
|---|---|---|
| EP | 0 088 046 A2 | 9/1983 |
| EP | 0 133 988 A2 | 3/1985 |
| EP | 0 143 949 A1 | 6/1985 |
| EP | 0171496 A2 | 2/1986 |
| EP | 0173494 A2 | 3/1986 |
| EP | 0 239 400 A2 | 9/1987 |
| EP | 0 463151 A1 | 1/1992 |
| EP | 0546073 A1 | 6/1993 |
| EP | 0 2426149 | 3/2012 |
| GB | 2177096 A | 1/1987 |
| JP | 3 068 180 B2 | 7/2000 |
| JP | 3 068 506 B2 | 7/2000 |
| JP | 3 068 507 B2 | 7/2000 |
| JP | 2006-515318 | 5/2006 |
| JP | 2008-538909 A | 11/2008 |
| WO | WO-1987/005330 A1 | 9/1987 |
| WO | WO-1988/009344 A1 | 12/1988 |
| WO | WO-1992/003918 A1 | 3/1992 |
| WO | WO-1992/015673 A1 | 9/1992 |
| WO | WO-1992/022645 A1 | 12/1992 |
| WO | WO-1992/022647 A1 | 12/1992 |
| WO | WO-1992/022670 A1 | 12/1992 |
| WO | WO-1993/012227 A1 | 6/1993 |
| WO | WO-1993/015722 A1 | 8/1993 |
| WO | WO-1994/000569 A1 | 1/1994 |
| WO | WO-1994/002602 A1 | 2/1994 |
| WO | WO-1994/010308 A1 | 5/1994 |
| WO | WO-1994/025585 A1 | 11/1994 |
| WO | WO-1995/007463 A1 | 3/1995 |
| WO | WO-1996/014436 A1 | 5/1996 |
| WO | WO-1996/033735 A1 | 10/1996 |
| WO | WO-1996/034096 A1 | 10/1996 |
| WO | WO-1997/013852 A1 | 4/1997 |
| WO | WO-1997/038731 A1 | 10/1997 |
| WO | WO-1998/014605 A1 | 4/1998 |
| WO | WO-1998/024884 A1 | 6/1998 |
| WO | WO-1998/024893 A2 | 6/1998 |
| WO | WO-1998/026277 A2 | 6/1998 |
| WO | WO-1998/052976 A1 | 11/1998 |
| WO | WO-1999/019477 A1 | 4/1999 |
| WO | WO-1999/049019 A2 | 9/1999 |
| WO | WO-1999/054440 A1 | 10/1999 |
| WO | WO-2000/006605 A2 | 2/2000 |
| WO | WO-2000/034317 A2 | 6/2000 |
| WO | WO-2000/076310 A1 | 12/2000 |
| WO | WO-2002/097395 A2 | 12/2002 |
| WO | WO-2003/047336 A2 | 6/2003 |
| WO | WO-2004/110345 A2 | 12/2004 |
| WO | WO-2005/040220 A1 | 5/2005 |
| WO | WO-2006/114704 A2 | 11/2006 |
| WO | WO-2006/138181 A2 | 12/2006 |
| WO | WO-2007/042261 A2 | 4/2007 |
| WO | WO-2007/098420 A2 | 8/2007 |
| WO | WO-2007/102525 A1 | 9/2007 |
| WO | WO-2008/119567 A2 | 10/2008 |
| WO | WO-2008/124858 A2 | 10/2008 |
| WO | WO-2008/143954 A3 | 3/2009 |
| WO | WO-2009/127691 A1 | 10/2009 |
| WO | WO-2010/001585 A1 | 1/2010 |
| WO | WO-2010/037838 A2 | 4/2010 |
| WO | WO-2010/054007 A1 | 5/2010 |
| WO | WO-2010/126137 A1 | 11/2010 |
| WO | WO-2011/051489 A2 | 5/2011 |
| WO | WO-2011/056997 A1 | 5/2011 |
| WO | WO-2011/071541 A2 | 6/2011 |
| WO | WO-2011/080796 A1 | 7/2011 |
| WO | WO-2012/057315 A1 | 5/2012 |
| WO | WO-2012/059486 A1 | 5/2012 |
| WO | WO-2012/145183 A2 | 10/2012 |
| WO | WO-2012/150319 A1 | 11/2012 |
| WO | WO-2013/026833 A1 | 2/2013 |
| WO | WO-2013/026837 A1 | 2/2013 |
| WO | WO-2013/075066 A2 | 5/2013 |
| WO | WO-2013/135896 A1 | 9/2013 |
| WO | WO-2014/072481 A1 | 5/2014 |
| WO | WO-2014/144722 A2 | 9/2014 |
| WO | WO-2014/151910 A1 | 9/2014 |
| WO | WO-2015/048272 A1 | 4/2015 |
| WO | WO/2016/001810 | * 1/2016 |
| WO | WO-2016/001810 A1 | 1/2016 |
| WO | WO-2017/008169 A1 | 1/2017 |

OTHER PUBLICATIONS

U.S. Appl. No. 07/574,748, Kay et al.
U.S. Appl. No. 07/575,962, Lonberg et al.
U.S. Appl. No. 07/610,515, Kucherlapati et al.
U.S. Appl. No. 07/904,068, Lonberg et al.
U.S. Appl. No. 07/919,297, Kucherlapati et al.
U.S. Appl. No. 08/112,848, Kucherlapati et al.
U.S. Appl. No. 08/155,301, Lonberg et al.
U.S. Appl. No. 08/161,739, Lonberg et al.
U.S. Appl. No. 08/165,699, Lonberg et al.

(56) References Cited

OTHER PUBLICATIONS

U.S. Appl. No. 08/209,741, Lonberg et al.
U.S. Appl. No. 08/234,145, Kucherlapati et al.
U.S. Appl. No. 08/376,279, Kucherlapati et al.
U.S. Appl. No. 08/430,938, Kucherlapati et al.
U.S. Appl. No. 08/462,837, Kucherlapati et al.
U.S. Appl. No. 08/463,191, Kucherlapati et al.
U.S. Appl. No. 08/464,584, Kucherlapati et al.
U.S. Appl. No. 08/486,853.
U.S. Appl. No. 08/486,859.
U.S. Appl. No. 08/759,620, Jakobovits et al.
Ahmed et al., HER2-directed therapy: current treatment options for HER2-positive breast cancer, Breast Cancer, 22:101-16 (2015).
Altschul et al., Basic local alignment search tool, J. Mol. Biol., 215:403-10 (1990).
Altschul et al., Gapped BLAST and PSI-BLAST: a new generation of protein database search programs, Nucleic Acids Res., 25:3389-402 (1997).
Altschul et al., Local alignment statistics, *Methods in Enzymology*, 266:460-80 (1996).
Aplin et al., Preparation, properties, and applications of carbohydrate conjugates of proteins and lipids, CRC Crit. Rev. Biochem., 259-306 (1981).
Arakawa et al., Protein—Solvent interactions in pharmaceutical formulations, *Pharm Res.* 8(3): 285-91 (1991).
Artsaenko et al., Expression of a single-chain Fv antibody against abscisic acid creates a wilty phenotype in transgenic tobacco, *The Plant J*, 8: 745-50 (1995).
Baek et al., CDH3/P-Cadherin regulates migration of HuCCT1 cholangiocarcinoma cells, *Anat Cell Biol.*, 43:110-7 (2010).
Bruhl et al., Depletion of CCR5-expressing cells with bispecific antibodies and chemokine toxins: a new strategy in the treatment of chronic inflammatory diseases and HIV, *Immunol.*, 166:2420-6 (2001).
Carter et al., High level *Escherichia coli* expression and production of a bivalent humanized antibody fragment, *Bio/Technology*, 10: 163-7 (1992).
Chalfie et al., Green fluorescent protein as a marker for gene expression, *Science*, 263:802-5 (1994).
Cheadle et al., Cloning and expression of the variable regions of mouse myeloma protein MOPC315 in *E. coli*: recovery of active FV fragments, *Mol. Immunol.*, 29: 21-30 (1992).
Cheson et al., Report of an international workshop to standardize response criteria for non-Hodgkin's lymphomas. NCI Sponsored International Working Group., *J Clin Oncol.*, 4:1244 (1999).
Chothia et al., Canonical structures for the hypervariable regions of immunoglobulins, *J. Mol. Biol.*, 196: 901 (1987).
Chothia et al., Conformations of immunoglobulin hypervariable regions, *Nature*, 342: 877-83 (1989).
Clackson et al., Making antibody fragments using phage display libraries, *Nature*, 352: 624-8 (1991).
Cole et al., Monoclonal Antibodies and Cancer Therapy, Alan R. Liss, Inc., 77-96 (1985).
Conacci et al., The control of BhB10-1 gene expression in the salivary gland of Bradysia hygida (Diptera, Sciaridae) is disrupted in vivo by a delayed effect of cycloheximide, *J Clin Invest*, 109:987-91 (2002).
Cook et al., The human immunoglobulin VH repertoire, Immunol. Today, 16(5): 237-42 (1995).
Creighton, Proteins: Structure and Molecular Properties, W. H. Freeman & Co., San Francisco, 79-86 (1983).
Cunningham et al., High-resolution epitope mapping of hGH-receptor interactions by alanine-scanning mutagenesis, *Science*, 244: 1081-5 (1989).
Dall'Acqua et al., Contribution of domain interface residues to the stability of antibody CH3 domain homodimers, *Biochem.*, 37:9266-73 (1998).
Dasgupta et al., Identification of molecular targets for immunotherapy of patients with head and neck squamous cell carcinoma, *Oral Oncology*, 42(3): 306-16 (2006).

Devereux et al., A comprehensive set of sequence analysis programs for the VAX, *Nucl. Acid Res.*, 12:387-95 (1984).
Duskin et al., Relationship of the structure and biological activity of the natural homologues of tunicamycin, *J. Biol. Chem.* 257:3105-9 (1982).
Edge et al., Deglycosylation of glycoproteins by trifluoromethanesulfonic acid, *Anal. Biochem.*, 118:131-7 (1981).
Epstein et al., Biological activity of liposome-encapsulated murine interferon y is mediated by a cell membrane receptor, *Proc. Natl. Acad. Sci. USA*, 82:3688-92 (1985).
Fanslow et al., Structural characteristics of CD40 ligand that determine biological function, *Semin. Immunol.*, 6:267-78 (1994).
Fecker et al., Expression of single-chain antibody fragments (scFv) specific for beet necrotic yellow vein virus coat protein or 25 kDa protein in *Escherichia coli* and Nicotiana benthamiana, *Plant Mol. Biol.*, 32: 979-86 (1996).
Feng et al., Progressive sequence alignment as a prerequisite to correct phylogenetic trees, *J. Mol. Evol.*, 35:351-360 (1987).
Fishwild et el., High-avidity human IgG kappa monoclonal antibodies from a novel strain of minilocus transgenic mice, *Nat Biotechnol.*, 14(7):845-51 (1996).
Fotouhi et al., Global hypomethylation and promoter methylation in small intestinal neuroendocrine tumors: an in vivo and in vitro study, *Epigenetics*, 9:987-97 (2014).
Furukawa et al., Roles of E- and P-cadherin in the human skin, *Microscopy Res. Technique*, 38(4):343-52 (1997).
Gabizon et al., Pharmacokinetics and tissue distribution of doxorubicin encapsulated in stable liposomes with long circulation times, *J. National Cancer Inst.*, 81(19):1484 (1989).
Gamallo et al., The prognostic significance of P-cadherin in infiltrating ductal breast carcinoma, *Modern Pathology*, 14:650-4, (2001).
Garbe et al., Vemurafenib, *Recent Results Cancer Res.*, 201:215-25 (2014).
GenBank Accession No. JU321883, TSA: Macaca mulatta Mamu_510094 mRNA sequence, dated Nov. 4, 2014.
GenBank Accession No. XM_002802511, Macaca mulatta cadherin 5, type 2 (CDHS), mRNA, Jun. 1, 2010.
GenBank Accession No. XM_002802516, Macaca mulatta cadherin-1-like (CDH1), mRNA, dated Jun. 1, 2010.
GenBank Accession No. JU473826, TSA: Macaca mulatta Mamu_375471 mRNA sequence, dated Nov. 4, 2014.
GenBank Accession No. JU473827, TSA: Macaca mulatta Mamu_375473 mRNA sequence, dated Nov. 4, 2014.
GenBank Accession No. NM_001792, *Homo sapiens* cadherin 2 (CDH2), transcript variant 1, mRNA, dated Feb. 26, 2018.
GenBank Accession No. NM_001793, *Homo sapiens* cadherin 3 (CDH3), transcript variant 1, mRNA, dated Mar. 17, 2018.
GenBank Accession No. NM_001794, *Homo sapiens* cadherin 4 (CDH4), transcript variant 1, mRNA, dated Feb. 26, 2018.
GenBank Accession No. NM_001795, *Homo sapiens* cadherin 5 (CDH5), mRNA, dated Feb. 6, 2018.
GenBank Accession No. NM_002354, *Homo sapiens* epithelial cell adhesion molecule (EPCAM), mRNA, dated Mar. 17, 2018.
GenBank Accession No. NM_004360, *Homo sapiens* cadherin 1 (CDH1), transcript variant 1, mRNA, dated Feb. 19, 2018.
GenBank Accession No. U55762, Cloning vector pEGFP-N1, complete sequence, enhanced green fluorescent protein (egfp) and neomycin phosphotransferase genes, complete cds, Aug. 22, 2003.
Graham et al., Characteristics of a human cell line transformed by DNA from human adenovirus type 5, *J. Gen Virol.*, 36:59-74 (1977).
Green et al., Antigen-specific human monoclonal antibodies from mice engineered with human Ig heavy and light chain YACs, *Nature Genetics*, 7:13-21 (1994).
Green et al., Regulation of B cell development by variable gene complexity in mice reconstituted with human immunoglobulin yeast artificial chromosomes, *J. Exp. Med.*, 188:483-95 (1998).
Gumbiner, Regulation of cadherin adhesive activity, *J. Cell. Biol.*, 148:399-404 (2000).
Hakimuddin et al., *Arch. Biochem. Biophys.*, 259:52 (1987).
Hardy et al., Aberrant P-cadherin expression is an early event in hyperplastic and dysplastic transformation in the colon, *Gut*, 50:513-519 (2002).

(56) References Cited

OTHER PUBLICATIONS

Hawkins et al., Selection of phage antibodies by binding affinity. Mimicking affinity maturation, *J. Mol. Biol.*, 254, 889-96 (1992).

Heim et al., Engineering green fluorescent protein for improved brightness, longer wavelengths and fluorescence resonance energy transfer, *Curr. Biol.* 6:178-82 (1996).

Hiatt et al., Production of antibodies in transgenic plants, *Nature*, 342: 76-8 (1989).

Higgins et al., Fast and sensitive multiple sequence alignments on a microcomputer, *CABIOS*, 5:151-3 (1989).

Holliger et al., "Diabodies": Small bivalent and bispecific antibody fragments, *Proc. Nat. Acad. Sci. USA*, 90(14):6444-8 (1993).

Hoppe et al., A parallel three stranded alpha-helical bundle at the nucleation site of collagen triple-helix formation, *FEBS Letters*, 344:191 (1994).

Wei et al., Validation and target gene screening of hsa-miR-205 in lung squamous cell carcinoma, *Chin Med J (Engl).*, 127:272-8 (2014).

Huston et al., Protein engineering of antibody binding sites: recovery of specific activity in an anti-digoxin single-chain Fv analogue produced in *Escherichia coli*, *Proc. Natl. Acad. Sci USA*, 85:5879-83 (1988).

Hwang et al., Hepatic uptake and degradation of unilamellar sphingomyelin/cholesterol liposomes: a kinetic study, *Proc. Natl Acad. Sci. USA*, 77:4030-4 (1980).

Ichiki et al., Regulation of the expression of human C epsilon germline transcript. Identification of a novel IL-4 responsive element, *J. Immunol.* 150:5408-17 (1993).

Imai et al., Identification of a novel tumor-associated antigen, cadherin 3/P-cadherin, as a possible target for immunotherapy of pancreatic, gastric, and colorectal cancers, *Clin Cancer Res.*, 14(20) 6487-95 (2008).

International Preliminary Report on Patentability, PCT/EP2016/058482, dated Oct. 17, 2017.

International Search Report and Written Opinion of the International Searching Authority, European Patent Office, dated Oct. 4, 2016.

Jamal-Hanjani et al., Translational implications of tumor heterogeneity, *Clin. Cancer Res.*, 21:1258-66 (2015).

Jarzab et al., Gene expression profile of papillary thyroid cancer: sources of variability and diagnostic implications, *Cancer Res*, 65(4):1587-97 (2005).

Jones et al., Replacing the complementarity-determining regions in a human antibody with those from a mouse, *Nature*, 321: 522-5 (1986).

Karlin et al., Applications and statistics fir multiple high-scoring segments in molecular sequences, Proc. Natl. Acad. Sci. U.S.A., 90:5873-87 (1993).

Kaufman et al., Selection and coamplification of heterologous genes in mammalian cells, *Methods Enzymol.*, 185:537-66 (1990).

Kendrick et al., Physical stabilization of proteins in aqueous solution in: Rational Design of Stable Protein Formulations: Theory and Practice, Carpenter and Manning, eds. *Pharmaceutical Biotechnology.* 13: 61-84 (2002).

Kim et al., P-cadherin expression in gastric carcinoma: its regulation mechanism and prognostic significance, *Human Pathology*, 41:877-885 (2010).

Kipriyanov et al., Bispecific tandem diabody for tumor therapy with improved antigen binding and pharmacokinetics, *J. Mol. Biol.*, 293:41-56 (1999).

Knappe et al., Herpesvirus saimiri-transformed macaque T cells are tolerated and do not cause lymphoma after autologous reinfusion, *Blood*, 95:3256-61 (2000).

Koehler et al., Continuous culture of fused cells secreting antibody of predefined specificity, *Nature*, 256: 495 (1975).

Kozbor et al., The production of monoclonal antibodies from human lymphocytes, *Immunology Today*, 4:72-9 (1983).

Kufer et al., Construction and biological activity of a recombinant bispecific single-chain antibody designed for therapy of minimal residual colorectal cancer, *Cancer Immunol. Immunother.*, 45:193-7 (1997).

Kufer et al., A revival of bispecific antibodies, *Trends in Biotechnology*, 22(5):238-44 (2004).

Landschulz et al., The leucine zipper: a hypothetical structure common to a new class of DNA binding proteins, *Science*, 240:1759-64 (1988).

Langer et al., Biocompatibility of polymeric delivery systems for macromolecules, *J. Biomed. Mater. Res.*, 15:267-77 (1981).

Langer, Controlled release of macromolecules, Chem. Tech., 12:98-105 (1982).

Löffler et al., A recombinant bispecific single-chain antibody, CD19 x CD3, induces rapid and high lymphoma-directed cytotoxicity by unstimulated T lymphocytes, *Blood*, 95(6):2098-103 (2000).

Lowman et al., Selecting high-affinity binding proteins by monovalent phage display, *Biochemistry*, 30(45):10832-7 (1991).

MacCallum et al., Antibody-antigen interactions: contact analysis and binding site topography, *J. Mol. Biol*, 262(5):732-45 (1996).

Mack et al., A small bispecific antibody construct expressed as a functional single-chain molecule with high tumor cell cytotoxicity, *PNAS*, 92(15):7021-25 (1995).

Mack et al., Biologic properties of a bispecific single-chain antibody directed against 17-1A (EpCAM) and CD3: tumor cell-dependent T cell stimulation and cytotoxic activity, *J. Immunol.*, 158(8):3965-70 (1997).

Malmborg et al., BIAcore as a tool in antibody engineering, *J. Immunol. Methods*, 183(1):7-13 (1995).

Marks et al., By-passing immunization. Human antibodies from V-gene libraries displayed on phage, *J. Mol. Biol.*, 222(3):581-97 (1991).

Martin et al., Irreversible coupling of immunoglobulin fragments to preformed vesicles. An improved method for liposome targeting, *J. Biol. Chem.*, 257(1): 286-8 (1982).

Martin et al., Structural families in loops of homologous proteins: automatic classification, modelling and application to antibodies, *J. Mol. Biol*, 263(5):800-5 (1996).

Mather et al., Culture of testicular cells in hormone-supplemented serum-free medium, *Annals N. Y Acad. Sci.*, 383:44-68 (1982).

Mather, Establishment and characterization of two distinct mouse testicular epithelial cell lines, *Biol. Reprod.*, 23: 243-52 (1980).

Mendez et al., Functional transplant of megabase human immunoglobulin loci recapitulates human antibody response in mice, *Nature Genetics*, 15(2):146-56 (1997).

Milic et al., Ectopic Expression of P-Cadherin Correlates with Promoter Hypomethylation Early in Colorectal Carcinogenesis and Enhanced Intestinal Crypt Fission In vivo, *Cancer Res.*, 68(19):7760-8 (2008).

Morrison et al., Chimeric human antibody molecules: mouse antigen-binding domains with human constant region domains, *Proc. Natl. Acad. Sci. USA*, 81(21):6851-5 (1984).

Morrison et al., Combinatorial alanine-scanning, *Cur Opin Chem Biol.*, 5(3):302-7 (2001).

Morrison, Transfectomas provide novel chimeric antibodies, *Science*, 229(4719):1202-7 (1985).

Naghavi et al., Global, regional, and national age-sex specific all-cause and cause-specific mortality for 240 causes of death, 1990-2013: a systematic analysis for the Global Burden of Disease Study 2013, *Lancet*, 385:117-71 (2015).

Needleman et al., A general method applicable to the search for similarities in the amino acid sequence of two proteins, *J. Mol. Biol.* 48(3):443-53 (1970).

Nolan et al., Fluorescence-activated cell analysis and sorting of viable mammalian cells based on beta-D-galactosidase activity after transduction of *Escherichia coli* lacZ, *Proc. Natl. Acad. Sci. U.S.A.* 85(8):2603-7 (1988).

Oi et al., Chimeric Antibodies, *BioTechniques*, 4:214 (1986).

Olsson et al., Human-Human Hybridoma Technology, Meth. Enzymol., 92:3-16 (1982).

Owen et al., Synthesis of a functional anti-phytochrome single-chain Fv protein in transgenic tobacco, *Bio/Technology*, 10(7): 790-4 (1992).

(56) References Cited

OTHER PUBLICATIONS

Padlan, Anatomy of the Antibody Molecue, *Molecular Immunology*, 31(3):169-217 (1993).
Pall, The next-generation ALK inhibitors, *Curr Opin Oncol.*, 27(2):118-24 (2015).
Parades et al., *Biochimica et Biophysica Acta* 1826, 297-311 (2012).
Parades et al., P-Cadherin Is Up-Regulated by the Antiestrogen ICI 182,780 and Promotes Invasion of Human Breast Cancer Cells, *Cancer Res.*, 64:8309-17 (2004).
Parades et al., P-Cadherin Overexpression Is an Indicator of clinical Outcome in Invasive Breast Carcinomas and Is Associated with CDH3 Promoter Hypomethylation, *Clin Cancer Res.*, 11(16):5869-77 (2005).
Patel et al., Cadherin switching in ovarian cancer progression, *Int. J. Cancer*, 106(2):172-7 (2003).
Pearson et al., Improved tools for biological sequence comparison, *Proc. Nat. Acad. Sci. U.S.A.*, 85:2444-8 (1988).
PeraltaSoler et al., P-Cadherin Expression in Breast Carcinoma Indicates Poor Survival, *Cancer*, 86:1263-72 (1999).
Presta, Antibody engineering, *Curr. Op. Struct Biol.*, 3(4):593-6 (1992).
Raag et al., Single-chain Fvs., *FASEB*, 9(1), 73-80 (1995).
Radice et al., Precocious mammary gland development in P-cadherin-deficient mice, *J. Cell Biol.*, 139: 1025-32 (1997).
Randolph et al., Surfactant-protein interactions, *Pharm Biotechnol.* 13:159-75 (2002).
Reichmann et al., Low neurotrophin receptor CD271 regulates phenotype switching in melanoma, *Nature*, 8:1-16(1988).
Remington's Pharmaceutical Sciences, 18 Edition, (A.R. Genrmo, ed.), (1990).
Sambrook et al., Molecular Cloning: A Laboratory Manual, Cold Spring Harbor Laboratory Press, Cold Spring Harbor, New York, 2001).
Schier et al., Efficient in vitro affinity maturation of phage antibodies using BIAcore guided selections, *Human Antibodies Hybridomas*, 7(3):97-105 (1996).
Schlereth et al., T-cell activation and B-cell depletion in chimpanzees treated with a bispecific anti-CD19/anti-CD3 single-chain antibody construct, Cancer Immunol. Immunother., 55: 503-14 (2005).
Shimoyama et al., Cadherin cell-adhesion molecules in human epithelial tissues and carcinomas, *Cancer Res.*, 49(8):2128-33 (1989).
Sidman et al., Controlled release of macromolecules and pharmaceuticals from synthetic polypeptides based on glutamic acid, *Biopolymers*, 22(1):547-56 (1983).
Smith et al., Comparison of Biosequences, *Adv. Appl. Math.* 2:482-9 (1981).
Filamentous fusion phage: novel expression vectors that display cloned antigens on the virion surface, *Science*, 228(4705):1315-17 (1985).
Songsivilai et al., Bispecific antibody: a tool for diagnosis and treatment of disease, *Clin. Exp. Immunol.* 79(3):315-21 (1990).
Stauber et al., Development and applications of enhanced green fluorescent protein mutants, *Biotechniques*, 24:462-471 (1998).
Stefansson et al., Prognostic impact of alterations in P-cadherin expression and related cell adhesion markers in endometrial cancer, *J. Clin. Oncol.*, 22(7):1242-52 (2004).

Sugiyama et al., A large-scale gene expression comparison of microdissected, small-sized endometrial cancers with or without hyperplasia matched to same-patient normal tissue, *Clin Cancer Res.*, 9(15):5589-600; (2003).
Sun et al. P-Cadherin Promotes Liver Metastasis and Is Associated with Poor Prognosis in Colon Cancer, *Am J Pathol.*, 179:380-90 (2011).
Sun et al., Side Effects of Chemotherapy, *Anticancer Agents Med Chem.*, (2015).
Takeda et al., Construction of chimaeric processed immunoglobulin genes containing mouse variable and human constant region sequences, *Nature*, 314(6010):452-4 (1985).
Takeichi, The cadherins: cell-cell adhesion molecules controlling animal morphogenesis, *Development*, 102:639-55(1988).
Nose et al., A Novel Cadherin Cell Adhesion Molecule: Its Expression Patterns Associated with Implantation and Organogenesis of Mouse Embryos, *J. Cell. Biol.*, 103:2649-58 (1986).
Taniuchi et al., Overexpressed P-Cadherin/CDH3 Promotes Motility of Pancreatic Cancer Cells by Interacting with p120ctn and Activating Rho-Family GTPases, *Cancer Res.*, 65:3092-9 (2005).
Teng et al., Construction and testing of mouse—human heteromyelomas for human monoclonal antibody production, *Proc. Natl. Acad. Sci. U.S.A.*, 80(23):7308-12 (1983).
Thotakura et al., Enzymatic deglycosylation of glycoproteins, *Meth. Enzymol.*, 138:350-9 (1987).
Tol et al., Monoclonal antibodies in the treatment of metastatic colorectal cancer: a review, *Clin Ther.*, 32(3):437-53 (2010).
Tomlinson et al., The human immunoglobulin VH repertoire, *Immunol Today*, 16(5):237-42 (1995).
Tomlinson et al., The repertoire of human germline VH sequences reveals about fifty groups of VH segments with different hypervariable loops, *J. Mol. Biol.*, 227(3):776-98 (1992).
Tomlinson et al., The structural repertoire of the human VK domain, *EMBO Journal*, 14:4628-38 (1995).
VanRoy, Beyond E-cadherin: roles of other cadherin superfamily members in cancer, *Nature Rev.*, V14(2):121-34 (2014).
Torre et al., Global Cancer Statistics, 2012, *CA Cancer J Clin.*, 65:87-108 (2015).
Urlaub et al., Isolation of Chinese hamster cell mutants deficient in dihydrofolate reductase activity, *Proc. Natl. Acad. Sci. USA*, 77(7):4216-20 (1980).
Yagi, et al.,Cadherin superfamily genes : functions, genomic organization, and neurologic diversity, *Genes Dev.*, 14:1169-80 (2000 ).
Yang et al., Inhibition of insulitis and prevention of diabetes in nonobese diabetic mice by blocking L-selectin and very late antigen 4 adhesion receptors, *Proc. Natl. Acad. Sci. U.S.A.*, 90(22):10494-8 (1993).
Zhang et al., PF-03732020: A Fully Human Monoclonal Antibody against P-Cadherin with Antitumor and Antimetastatic Activity, *Clin Cancer Res.*, 16(21):5177-88 (2010).
Caaveiro et al., 4ZMT Crystal structure of human P-cadherin (ss-X-dimer-long), Research Collaboratory for Structural Bioinformatics Protein Data Bank (RCSB PDB) (priority date Apr. 17, 2015; filed Apr. 18, 2016).
Rader, DARTs take aim at BiTEs, Inside Blood, 117(17): 4403-5 (2011).
Root et al., Development of PF-06671008, a highly potent Anti-P-cadherin/Anti-CD3 bispecific DART molecule with extended half-life for the treatment of cancer, *Antibodies.* 5:1-30 (2016).
Yao et al., Research Progress of anti-CD3/anti-tumor antigen bispecific antibody mediated T lymphocyte anti-tumor effect and mechanism, *Chinese Journal of Cancer Biotherapy.* 12:237-9 (2005).

* cited by examiner

Epitope Mapping CDH3 Constructs

Expression of human and murine CDH3 on CHO cells (controls)

Expression of chimeric CDH3 molecules on CHO cells

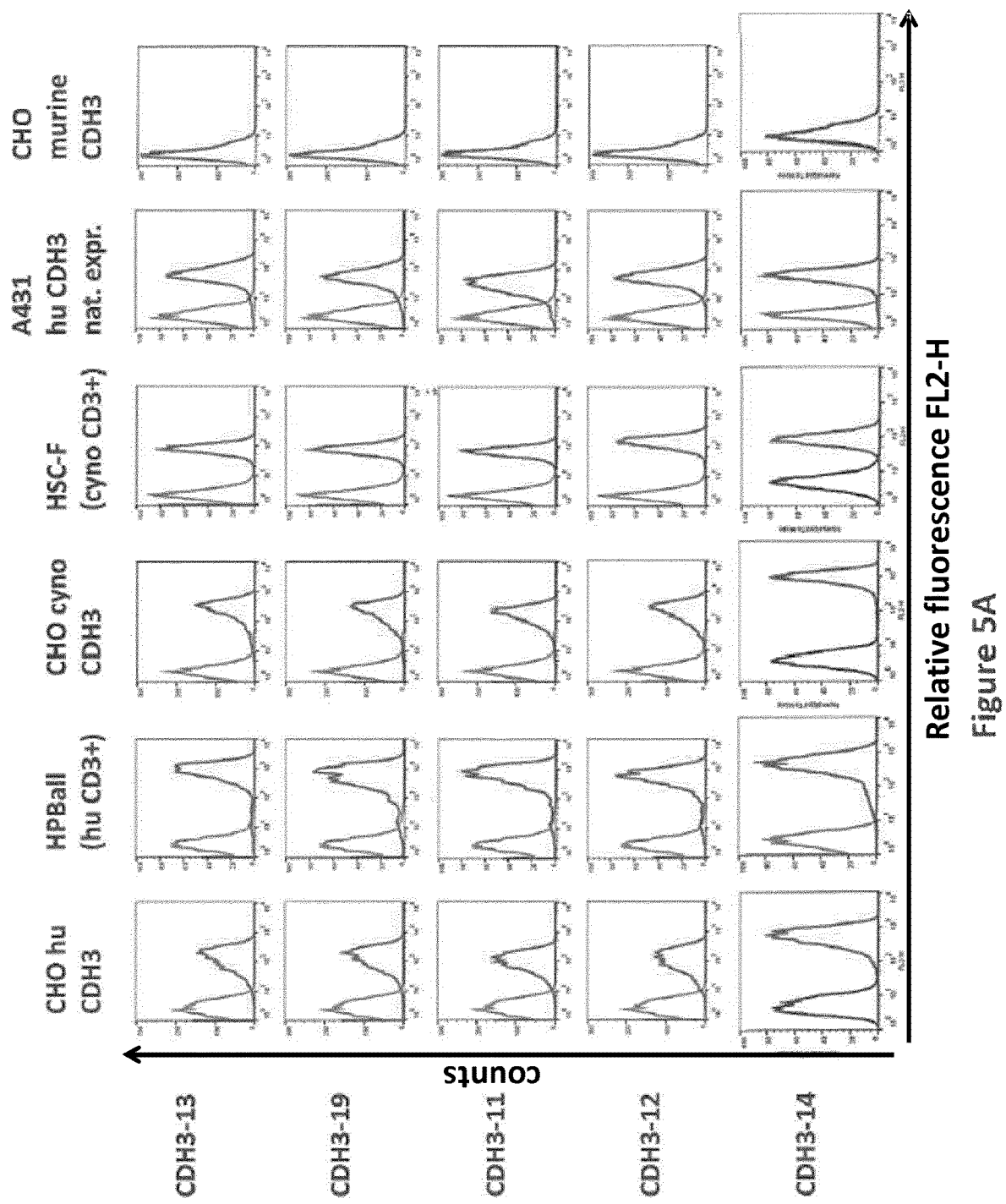

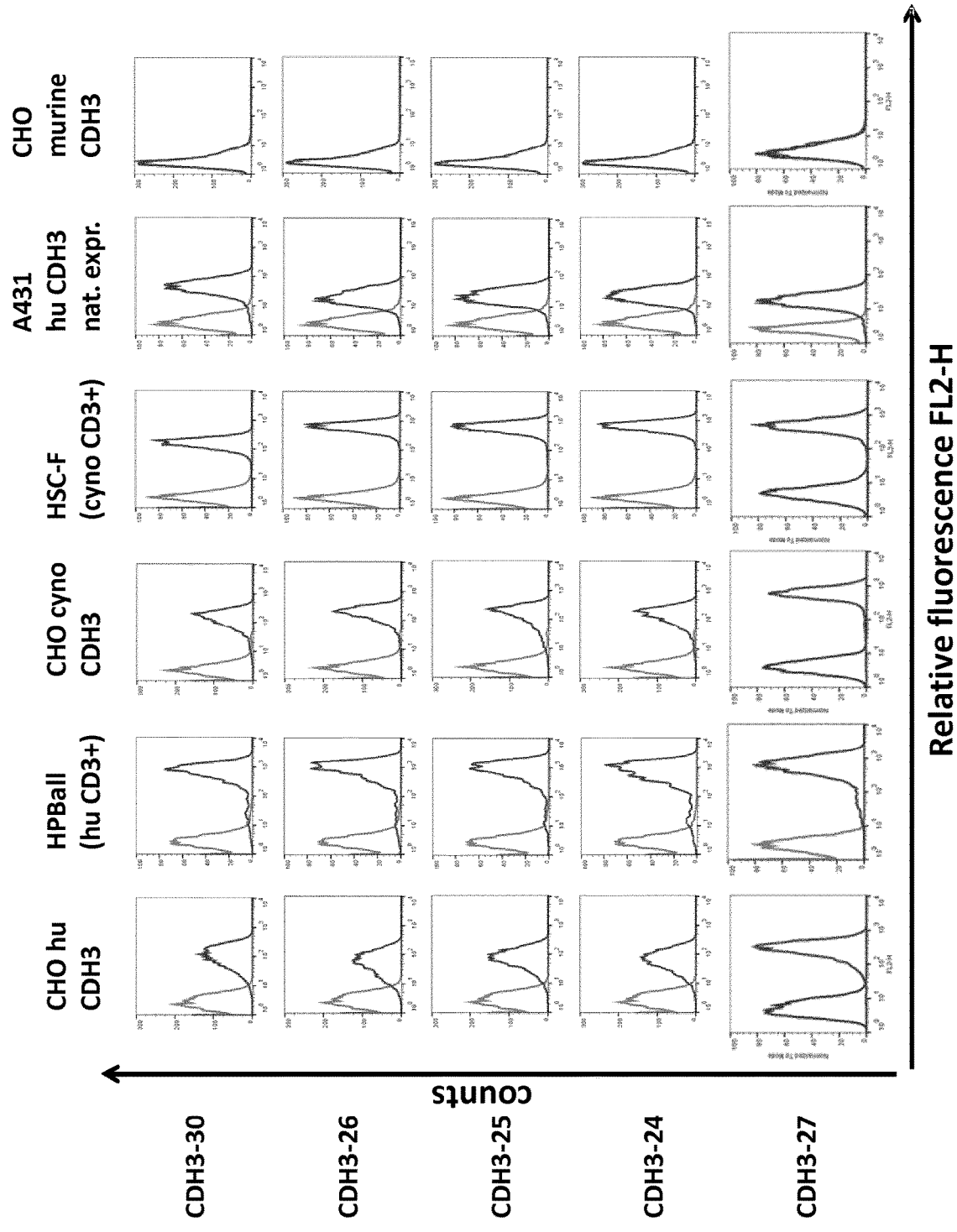

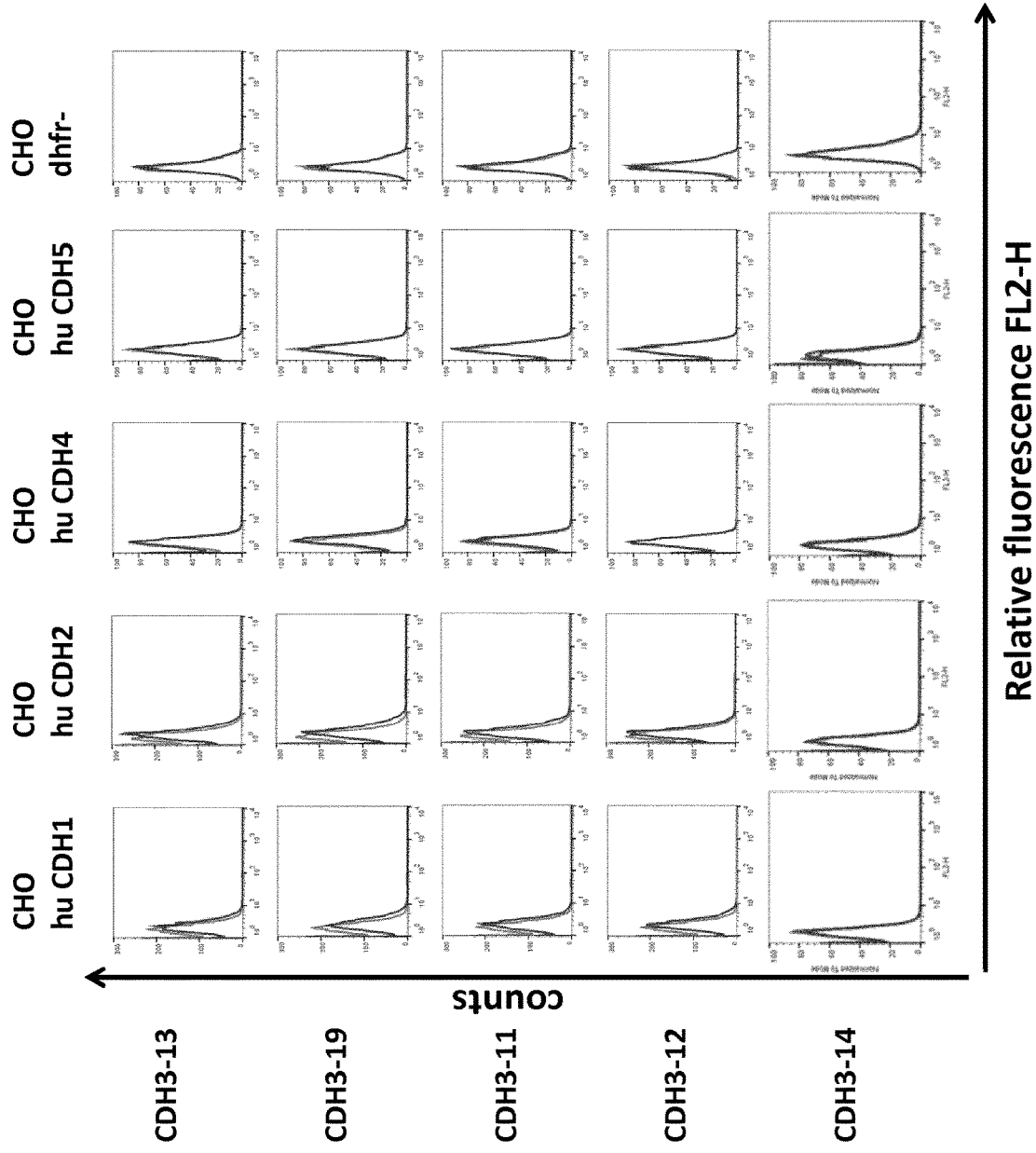

BISPECIFIC ANTIBODY CONSTRUCTS FOR CDH3 AND CD3

The present invention relates to a bispecific antibody construct comprising a first human binding domain which binds to human CDH3 on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

Introduction

The superfamily of cadherins encompasses more than 100 members in humans including the so called classical cadherins P-cadherin, E-cadherin, N-cadherin and R-cadherin, each of which is active in an individual set of tissues (Takeichi M. Development, 102:639-55(1988), van Roy F., Nature Rev., V14:121-134 (2014)). Cadherins inter alia play an essential role in the development of adult tissues and organs as well as in the homeostasis of various tissues (Conacci-Sorrell M, et al., J Clin Invest, 109:987-91, (2002)). Cadherins are transmembrane glycoproteins that regulate cell-cell adhesion processes by the formation of calcium dependend junctions and by converting mechanical stimuli into electrochemical activity, a process referred to as mechanotrunsduction (Gumbiner J. Cell. Biol., 148:399-404 (2000); Yagi, et al., Genes Dev., 14:1169-1180 (2000, Parades et al. Biochimica et Biophysica Acta 1826, 297-311 (2012)).

Placental cadherin (P-cadherin), also known as Calcium dependent cell-cell adhesion protein 3 (CDH3), is a 118 kDa protein with a large extracelluar domain (ECD) of about 800 amino acids. The CDH3 ECD comprises five cadherin repeats, herein denominated as (extracellular) domains 1-5/Dom1-Dom5/D1-D5, each consisting of about 110 amino acids. The proteins with the highest sequence homology to P-Cadherin are E-cadherin with a 53% sequence homology and N-cadherin with a 39% homology.

The expression level of P-cadherin is considered to be low in healthy adult individuals and to be limited to the basal or lower layers of stratified epithelia, including prostate and skin, breast myoepithelial cells (Takeichi M. J Cell Biol 103:2649-58, (1986) and Shimoyama Y, et al., Cancer Res, 49:2128-33(1989)). Although not being lethal in gene knockout mice, loss of P-cadherin function has been shown to be associated with developmental defects, as well as hyperplasia and dysplasia of the mammary epithelium. (G. L. Radice et al. J. Cell Biol. 139: 1025-1032 (1997)).

In contrast to the low gene expression level in healthy individuals, expression of P-cadherin is upregulated in the context of some diseases including, e.g. immune diseases like Crohn's disease and colitis (Hardy, et al., Gut 50:513-519 (2002)). In addition, P-cadherin is considered to play a significant role for the pro-invasive nature of cancer cells (Furukawa, et al., Microscopy Res. Technique 38 (4):343-352 (1997), Parades et al. Clin Cancer Res. 11(16), 5869-5877 (2005), Parades et al. Biochimica et Biophysica Acta 1826, 297-311 (2012)). Upregulation of P-Cadherin has been described in various tumors, including colorectal, lung (NSCLC), breast (triple negative), pancreas, head & neck, thyroid, cervix, ovarian and gastric cancer (Milic et al. Cancer Res 68: (19) 7760-7768 (2008). Imai et al. Clin Cancer Res 14(20) 6487-6495 (2008), Paredes et al Clin Cancer Res 11 (16) 5869-5877 (2005), Dasgupta et al. Oral Oncology 42, 306-316 (2006), Jarzab et al. Cancer Res; 65: (4) 1587-1597 (2005). Patel et al. Int. J. Cancer: 106, 172-177 (2003), Kim et al. Human Pathology 41, 877-885 (2010)). Moreover, an increased expression of P-cadherin was observed to be correlated with low survival rates of patients in various cancer types (Sun L et al. Am J Pathol. 2011; 179:380-90; Gamallo, Modern Pathology, 14:650-654, (2001); Stefansson, et al., J. Clin. Oncol. 22(7):1242-1252 (2004), Parades et al. Cancer Res. 64, 8309-8317 (2004)), Taniuchi K et al. Cancer Res. 2005; 65:3092-9; Paredes J et al. Clin Cancer Res. 2005; 11:5869-77; Hardy R G et al. Gut. 2002; 50:513-9; Peralta Soler A et al. Cancer. 1999; 86:1263-72).

Following cardiovascular diseases, neoplasms rank second amongst the death-causing diseases in the category of non-communicable diseases, causing about 8.3 Million deaths in 2013 worldwide (GBD 2013 Lancet 2015; 385: 117-71). The absolute number of cancer cases has increased by 45.6% since 1990 which can be attributed to the fact that the world population is increasing, that people get older and that the prevalence of established risk factors (e.g. smoking, overweight, physical inactivity) is also increasing (GBD 2013 Lancet 2015; 385: 117-71, Torre L A et al. C A Cancer J Clin. 2015; 65:87-108). In men lung cancer is the leading cause of death with an estimated number of about 1.1 Million cases per year followed by liver and stomach cancer. In women breast cancer is the leading cause of death with about 0.5 Million cases per year followed by lung and colon cancer. About 14 Million of new cases of cancer are estimated to occur in 2012 worldwide led by lung cancer with ~1.2 Million cases in men and breast cancer with ~1.7 Million in women (Torre L A et al. CA Cancer J Clin. 2015; 65:87-108). Alltogether cancer constitutes a large burden on society around the world and there is a high need for treatment options to fight this disease.

Common strategies to treat cancer involve surgery, followed by chemotherapy, radiotherapy or more recently by targeted therapies or combinations thereof (e.g. NCCN guidelines for oncology). Chemotherapeutic agents encompass nucleotide analogs like 5-flurouracil (5-FU), DNA damaging agents such as oxaliplatin and topoisomerase inhibitors like irinotecan or microtubule inhibitors such as docetaxel, which all lead to inhibition of tumor cell proliferation. Targeted therapies include for example small molecule compounds which selectively inhibit mutated oncogenic kinases like the BRAF V600E selective compound vemurafenib (Garbe C. et al Recent Results Cancer Res. 2014; 201:215-25), which is approved or the treatment of melanoma or the anaplastic lymphoma linase (ALK) inhibitors crizotinib and ceritinib approved for the treatment of lung cancer (Pall G. Curr Opin Oncol. 2015; 27:118-24). In addition there are antibody based compounds like cetuximab and panitumumab, which recognize and inactivate the epithermal growth factor receptor (EGFR) and which are approved for the treatment of KRAS wild-type colon cancer (Tol J, Punt C J. Clin Ther. 2010; 32:437-53) or trastuzumab, which recognizes Her2 and is approved for breast cancer therapy (Ahmed S. et al. Breast Cancer. 2015; 22:101-16).

Despite the development of a wide range of therapeutic intervention, there is except for sporadic cases no cure of this heterogenous disease available. The heterogeneity of the individual tumors leads to the fact that only a limited number of patients respond to a certain therapy and furthermore during tumor progression resistance develops against the therapeutic agents (Jamal-Hanjani M. et al Clin Cancer Res. 2015; 21:1258-1266). Finally the side effects of the drugs could also lead to treatment interruption or discontinuation, although the newly developed targeted therapies appear to be better tolerated (http://www.cancer.net/naviaatinc-cac-crehow-cancer-treated/chemotherapy/side-effects-chemotherapy; Sun GC et al. Anticancer Agents Med Chem. 2015 Mar. 17. [Epub ahead of print]).

Also for these reasons there is still a high medical need for the development of new drugs.

The overexpression of CDH3 in tumor cells provides the basis for a new approach to treat cancers, by using a bispecific antibody which recognizes CDH3 overexpressing tumor cells and kills them by redirection of cytotoxic T cells which are recognized be CD3 binding moiety of this antibody.

Expression analyses which have been performed either on the RNA level or at the protein level using primarily immunohistochemistry demonstrate that CDH3 is expressed at high and well detectable level in wide range of different types of cancer, which include cancer of the colon (Milic et al., Kita et al, Imai et al., http://wwAw.proteinatlas.org/), lung including non-small cell and small cell lung cancer (Imai et al, human protein atlas), breast preferably triple negative cancers (Perou et al, Paredes et al, Turashvili et al, Imai et al.), pancreas (Imai et al., Taniuchi et al), head+neck including squamous cell carcinoma to the tongue (Dasgupta et al; own unpublished data), thyroid (Jarzab et al, Rocha et al., human protein atlas), cervix (Imai et al., Han et al.), ovarian preferably in stage II and above (Patel et al human proeion atlas), gastric (Kim et al; Imai et al), endometrium (Sugiyama Y et al. Clin Cancer Res. 2003; 9:5589-600; human protein atlas), cholangiocarcinoma (Back S et al. Anat Cell Biol. 2010; 43:110-7; Imai et al), bladder (Imai et al, own unpublished data), prostate (Imai et al; own unpublished data), testicular (Imai et al) soft tissue sarcoma (Imai et al), esophagus (own unpublished data), kidney (own unpublished data).

Future analyses may demonstrate elevated expression in additional tumors or subtypes thereof, which may then also become relevant for such a therapy. Fotouhi et al for example demonstrated decreased methylation of the CDH3 promoter in small intestinal neuroendocrine tumors, which may lead to elevated CDH3 protein expression (Fotouhi O et al. Epigenetics. 2014; 9:987-97). A positive correlation was observed between elevated expression of CDH3 and miR-205, a micro RNA which appears to be a specific marker for squamous lung cell carcinoma (Huang W et al. Chin Med J (Engl). 2014; 127:272-8).

In contrast to the elevated expression of CDH3 in tumor tissue its expression in normal tissue is low or not detectable (Milic et al., Imai et al, Taniuchi et al, Rocha et al, Dasgupta et al, Han et al, Patel., Kim et al, Sugiyama et al, Jarzab et al., human protein atlas). Taken together this provides evidence that CDH3 is a suitable target for the proposed bispecific antibody approach.

A variety of antibodies binding to P-cadherin has been described and the most thoroughly characterized have been published within the following patents: WO9919477, WO02/097395, WO04/110345, WO06/114704, WO07/102525, WO2010/001585, WO2010126137; WO2010054007, WO2011056997, WO2011080796, WO2011071541.

Some of the antibodies known in the art block the function of CDH3, for example by interfering with its adhesion properties such as the anti CDH3 antibody PF-03732010 (Zhang C C et al. Clin Cancer Res. 2010; 16:5177-88). In vitro this antibody leads to the disruption of 3D speroids with changes in intracellular signaling such as dissociation of β-catenin at nanomolar concentrations, but did not inhibit proliferation. In vivo inhibition of tumor growth and the formation of metastasis as well as prolonged survival were observed in preclinical models at doses of 10 mg/kg and in a manner, which depends on the expression level of CDH3. Mechanistically, it cannot be excluded that the antitumor effects in vivo are additionally mediated by the process of, antibody-dependend cell cytotoxicity (ADCC), which involves cell killing by the binding of cytotoxic T cells to the Fc domain of the immunoglobulins. Such a mechanism of action has been ascribed to some of the claimed anti CDH3 antibodies. Although, blocking of P-cadherin activity has been described as an approach to inhibit the growth of P-cadherin-expressing tumors, the results achieved frequently remain unsatisfactory, because they delay tumor growth or at best induce tumor stasis, but do not eliminate the tumor.

To improve their inhibitory effect on tumor growth, antibodies can be conjugated to cytotoxic or cytostatic agents (e.g. a chemotherapeutic agent, a toxin, a radioactive isotope or the like) resulting in antibody-drug conjugates (ADCs), or broadly, immunoconjugates. Immunoconjugates allow for the targeted delivery of a drug moiety to a tumor, and intracellular accumulation thereof. The efficacy of such immunoconjugates with regard to the killing of tumor cells strongly depends on various parameters like the internalization behavior of the target molecule which is usually located in the cell membrane with an extracellular domain, as well as the mode of action of the respective immunoconjugate. Overall, coupling to an immunoconjugate has been shown to significantly enhance the anti-tumor efficacy of various antibodies.

More recently bispecific molecules binding to the target molecule as well as to T cells have shown promising results circumventing many of the above mentioned drawbacks. These drug molecules do not rely on the complete blocking of the function of a target or on the proliferation state of a target cell since they do utilize the very effective natural killing effect of T cells. One example for such bispecific molecules are the bispecific anti-target x anti-CD3 single chain antibody construts, which have previously been shown to mediate a T cell-related killing of the target cell with a very high efficiency, see e.g. Blinatumomab.

To distinguish a bispecific scFv molecule a good drug substance which will ultimately help to cure patients a multiplicity of different criteria has to be fulfilled. The combination and stringency of these criteria make the occurrence of molecules fulfilling these needs an extremely rare and unpredictable event. The most obvious criterion is the efficiency of the drug candidates.

The efficiency of such molecules depends on multiple parameters on the target binding domain as well as on the T cell recruiting part of the bispecific molecule. Especially on the target binding part of the bispecific scFv molecule are unpredictable since they vary very strongly depending on the nature of the target molecule including its ternary as well as quaternary structure. Amongst the efficiency defining parameters the binding kinetics between the target- and the bispecific binding molecule as well as the exact binding region, the so called binding epitope play major roles.

Anti-CDH3 monoclonal antibodies—as holds true generally for any other monoclonal antibodies—function by way of highly specific recognition of their target molecules. They recognize only a single site, or epitope, on their target CDH3 molecule. In addition, many antibodies have been found to exert their function in a species-specific manner. This specificity however, inherent not only to CDH3 monoclonal antibodies (and fragments thereof), but to monoclonal antibodies in general, is a significant impediment to their development as therapeutic agents for the treatment of human diseases. In order to obtain market approval any new candidate medication must pass through rigorous testing. This testing is subdivided into preclinical and clinical phases; whereas the latter is performed in human patients, the former is performed in animals. The aim of pre-clinical testing is to prove that the drug candidate has the desired activity and most importantly is safe. Only when the safety in animals and possible effectiveness of the drug candidate has been established in preclinical testing this drug candidate will most likely be approved for clinical testing in humans by the respective regulatory authority. Drug candidates can be tested for safety in animals in the following three ways, (i) in a relevant species, i.e. a species where the drug candidates can recognize the ortholog antigens, (ii) in a transgenic animal containing the human antigens and (iii) by use of a surrogate for the drug candidate that can bind the ortholog antigens present in the animal. Limitations of transgenic animals are that this technology is typically limited to rodents. Between rodents and man there are significant differences in the physiology and the safety results cannot be easily extrapolated to humans. The limitations of a surrogate for the drug candidate are the different composition of matter compared to the actual drug candidate and often the animals used are rodents with the limitation as discussed above. Therefore, preclinical data generated in rodents are of limited predictive power with respect to the drug candidate.

The approach of choice for safety testing is the use of a relevant species, preferably a primate and, due to genetic similarity, a Chimpanzee. However, Chimpanzees are considered as endangered species and due to their human-like nature, the use of such animals for drug safety testing has been banned in Europe and is highly restricted elsewhere.

Though T cell-engaging bispecific single chain antibodies described in the art have great therapeutic potential for the treatment of malignant diseases, most of these bispecific molecules are limited in that they are species specific and recognize only human antigen, and likely the primate i.e. macaque counterpart. Moreover, most of said bispecific molecules are further limited in that they fail to exert their desired function across species borders, such that they may recognize human and primate homologes but fail to exert, for instance, T cell-mediated cytotoxicity.

DETAILED DESCRIPTION OF THE INVENTION

As there is still a need for having available further options for the treatment of the various cancer types disclosed herein, there are provided herewith means and methods for the solution of this problem in the form of a bispecific antibody construct with one binding domain directed to CDH3 and with a second binding domain directed to CD3 on T cells.

The present invention provides, in a first aspect, for a bispecific antibody construct comprising a first preferably human binding domain which binds to an epitope cluster of human CDH3 on the surface of a target cell and comprising a second preferably human binding domain which binds to human CD3 on the surface of a T cell, wherein the epitope cluster of human CDH3 is comprised within amino acid positions 291-363 (SEQ ID NO: 36) of human CDH3.

In a preferred embodiment of the present invention, the bispecific antibody construct is characterized in that the first binding domain also binds to macaque CDH3, preferably to *Macaca fascicularis* CDH3.

This functionality across the species means that the same molecule can be used in preclinical animal studies as well as in clinical studies in humans. This leads to highly comparable results and a much-increased predictive power of the animal studies compared to species-specific surrogate molecules. Since both the CD3 and the CDH3 binding domain of the CDH3×CD3 bispecific antibody constructs of the invention are cross-species specific and functional, i.e. reactive with the human and macaque antigens exerting a comparable effect of T cell-mediated cytotoxicity, it can be used both for preclinical evaluation of safety, activity and/or pharmacokinetic profile of these binding domains in primates and—in the identical form—as drug in humans. It will be understood that in a preferred embodiment, the cross-species specificity of the first and second binding domain of the antibody constructs of the invention is identical.

In view of the above, the need to construct a surrogate CDH3×CD3 bispecific antibody construct for testing in a phylogenetic distant (from humans) species disappears. As a result, the identical molecule can be used in animal preclinical testing as is intended to be administered to humans in clinical testing as weil as following market approval and therapeutic drug administration. The ability to use the same molecule for preclinical animal testing as in later administration to humans virtually eliminates, or at least greatly reduces, the danger that the data obtained in preclinical animal testing have limited applicability to the human case. In short, obtaining preclinical safety data in animals using the same molecule as will actually be administered to humans does much to ensure the applicability of the data to a human-relevant scenario. In contrast, in conventional approaches using surrogate molecules, said surrogate molecules have to be molecularly adapted to the animal test system used for preclinical safety assessment. Thus, the molecule to be used in human therapy in fact differs in sequence and also likely in structure from the surrogate molecule used in preclinical testing in pharmacokinetic parameters and/or biological activity, with the consequence that data obtained in preclinical animal testing have limited applicability I transferability to the human case. The use of surrogate molecules requires the construction, production, purification and characterization of a completely new construct. This leads to additional development costs and time necessary to obtain that molecule. In sum, surrogates have to be developed separately in addition to the actual drug to be used in human therapy, so that two lines of development for two molecules have to be carried out. Therefore, a major advantage of the preferably human, CDH3×CD3 bispecific antibody construct of the invention exhibiting cross-species specificity and functionality (i.e. reactivity) described herein is that the identical molecule can be used for therapeutic agents in humans and in preclinical animal testing.

With the cross-species specific CDH3×CD3 bispecific antibody construct of the invention it is also no longer necessary to adapt the test animal to the drug candidate intended for administration to humans, such as e.g. the creation of transgenic animals. The, preferably human, CDH3×CD3 bispecific antibody construct of the invention exhibiting cross-species specificity and reactivity according to the uses and the methods of invention can be directly used for preclinical testing in non-chimpanzee primates like macaques, without any genetic manipulation of the animals. As well known to those skilled in the art, approaches in which the test animal is adapted to the drug candidate always bear the risk that the results obtained in the preclinical safety testing are less representative and predictive for humans due to the modification of the animal. For example, in transgenic animals, the proteins encoded by the transgenes are often highly over-expressed. Thus, data obtained for the biological activity of an antibody against this protein antigen may be limited in their predictive value for humans in which the protein is expressed at much lower, more physiological levels.

A further advantage of the preferably human, CDH3×CD3 bispecific antibody construct of the invention is the ability of extracting multiple blood samples when using it as part of animal preclinical testing, for example in the course of pharmacokinetic animal studies. Multiple blood extractions can be much more readily obtained with a non-chimpanzee primate than with lower animals, e.g. a mouse. The extraction of multiple blood samples allows continuous testing of blood parameters for the determination of the biological effects induced by the CDH3×CD3 bispecific antibody construct of the invention. Furthermore, the extraction of multiple blood samples enables the researcher to evaluate the pharmacokinetic profile of the, preferably human, CDH3×CD3 bispecific antibody construct of the invention as defined herein. In addition, potential side effects, which may be induced by said CDH3×CD3 bispecific antibody construct of the invention reflected in blood parameters can be measured in different blood samples extracted during the course of the administration of said antibody.

The advantages of the CDH3×CD3 bispecific antibody construct of the invention as defined herein exhibiting cross-species specificity may be briefly summarized as follows:

First, the CDH3×CD3 bispecific antibody construct of the invention as defined herein used in preclinical testing is the same as the one used in human therapy. Thus, it is no longer necessary to develop two independent molecules, which may differ in their pharmacokinetic properties and biological activity. This is highly advantageous in that e.g. the pharmacokinetic results are more directly transferable and applicable to the human setting than e.g. in conventional surrogate approaches.

Second, the uses of the CDH3×CD3 bispecific antibody construct of the invention as defined herein for the preparation of therapeutics in human is less cost- and labor-intensive than surrogate approaches.

Third, the CDH3×CD3 bispecific antibody construct of the invention as defined herein can be used for preclinical testing not only in one primate species, but in a series of different primate species, thereby limiting the risk of potential species differences between primates and human.

Fourth, chimpanzee as an endangered species for animal testing can be avoided if desired.

Fifth, multiple blood samples can be extracted for extensive pharmacokinetic studies.

Sixth, due to the human origin of the antibody constructs according to a preferred embodiment of the invention, the generation of an immune reaction against said binding molecules is minimized when administered to human patients. Induction of an immune response with antibodies specific for a drug candidate derived from a non-human species as e.g. a mouse leading to the development of human-anti-mouse antibodies (HAMAs) against therapeutic molecules of murine origin is excluded.

The therapeutic use of the CDH3×CD3 bispecific antibody construct of the invention provides a novel and inventive therapeutic approach for cancer, preferably solid tumors, more preferably carcinomas and other cancer indications as listed below. As shown in the following examples, the CDH3×CD3 bispecific antibody construct of the invention provides an advantageous tool in order to kill CDH3-expressing human cancer cells. Moreover, the cytotoxic activity of the CDH3×CD3 bispecific antibody constructs of the invention provides an advantageous mode of action compared with classical (monospecific) IgG molecules or ADCs.

For the characterization of drug candidates in animal models a species cross reactivity to a relevant animal species is essential and the interspecies affinity gap should be kept under a 10 fold affinity difference to ensure a predictive animal model setup. Macaque monkeys (and especially cynomolgus) are considered to be among the most relevant species for efficacy and toxicity testing with the highest predictive value. To analyse if antibody constucts fulfill the efficiency criteria the respective cytotoxicity assays have to be developed and qualified.

To prevent adverse side effects it has to be ensured that the target binding part of the bispecific antibody construct specifically binds to P cadherin and none of its above described closest homologs, or other proteins present int the body.

Antibody constructs of the present invention preferably do not bind to the CHD3 extracellular domain D1 (positions 108-215 of SEQ ID NO: 1), they preferably do not bind to the CHD3 extracellular domain D4 (positions 441-546 of SEQ ID NO: 1), and they preferably do not bind to the CHD3 extracellular domain D5 (positions 547-650 of SEQ ID NO: 1).

According to the most preferred embodiment of the present invention, the bispecific antibody construct is characterized in that the first binding domain binds to an epitope which is comprised within amino acid positions 291-327 (SEQ ID NO: 34) of human CDH3. The antibodies binding specifically to amino acid positions 291-327 (SEQ ID NO: 34), preferably do not bind to the CHD3 extracellular domain D3 of human CDH3 (positions 328-440 of SEQ ID NO: 1).

A preferred antibody construct according to the invention can also be defined as a bispecific antibody construct comprising a first preferably human binding domain which binds to an epitope of human CDH3 on the surface of a target cell and a second preferably human binding domain which binds to human CD3 on the surface of a T cell, wherein the antibody construct binds to the same epitope as or competes for binding to CDH3 with the antibody denominated CDH3-11, CDH3-12, CDH3-13 or CDH3-14, i.e., the antibody comprising:
  a VH region as depicted in SEQ ID NO: 155 and a VL region as depicted in SEQ ID NO: 156,
  a VH region as depicted in SEQ ID NO: 165 and a VL region as depicted in SEQ ID NO: 166,
  a VH region as depicted in SEQ ID NO: 175 and a VL region as depicted in SEQ ID NO: 176; or
  a VH region as depicted in SEQ ID NO: 185 and a VL region as depicted in SEQ ID NO: 186.

In another aspect of the present invention, the bispecific antibody construct is characterized in that the first binding domain binds to an epitope which is comprised within amino acid positions 328-363 (SEQ ID NO: 35) of human CDH3.

A preferred antibody construct according to the invention can also be defined as a bispecific antibody construct comprising a first preferably human binding domain which binds to an epitope of human CDH3 on the surface of a target cell and a second preferably human binding domain which binds to human CD3 on the surface of a T cell, wherein the antibody construct binds to the same epitope as or competes for binding to CDH3 with the antibody denominated CDH3-24, i.e., the antibody comprising a VH region as depicted in SEQ ID NO: 285 and a VL region as depicted in SEQ ID NO: 286.

Another preferred antibody construct according to the invention can also be defined as a bispecific antibody construct comprising a first preferably human binding domain which binds to an epitope of human CDH3 on the surface of a target cell and a second preferably human binding domain which binds to human CD3 on the surface of a T cell, wherein the antibody construct binds to the same epitope as or competes for binding to CDH3 with the antibody denominated CDH3-25, CDH3-26 or CDH3-27, i.e., the antibody comprising:
 a VH region as depicted in SEQ ID NO: 295 and a VL region as depicted in SEQ ID NO: 296,
 a VH region as depicted in SEQ ID NO: 305 and a VL region as depicted in SEQ ID NO: 306, or
 a VH region as depicted in SEQ ID NO: 315 and a VL region as depicted in SEQ ID NO: 316.

Whether or not an antibody construct competes for binding with another given antibody construct can be measured in a competition assay such as a competitive ELISA or a cell-based competition assay. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Read-out occurs via flow cytometry.

In another embodiment of the present invention, the bispecific antibody construct is characterized in that the first binding domain binds to an epitope which is comprised within amino acid positions 328-363 (SEQ ID NO: 35) of human CDH3 and to an epitope which is comprised within amino acid positions 404-440 (SEQ ID NO: 390) of human CDH3.

Furthermore, antibody constructs of the present invention preferably do not bind to an epitope which is comprised within amino acid positions 216-252 or 253-290 of human CDH3 as depicted in SEQ ID NO: 1.

Furthermore, the antibody constructs of the present invention preferably do not bind to an epitope which is comprised within amino acid positions 364-403 of human CDH3 as depicted in SEQ ID NO: 1.

The antibody constructs binding specifically to an epitope which is comprised within amino acid positions 328-363 (SEQ ID NO: 35) preferably do not bind to the CHD3 extracellular domain D2 of human CDH3 (positions 216-327 of SEQ ID NO: 1).

One advantage of the present invention is the provision of a bispecific antibody construct comprising a binding domain which binds to CD3 and a binding domain capable of binding to CDH3, whereas both binding domains exhibit a cross-species specificity to human and macaque CDH3. Unexpectedly, it was found that the CDH3×CD3 bispecific antibody constructs of the invention not only specifically bind to the human and the macaque CDH3 homologes of CDH3 and CD3, but also exert T cell-mediated cytotoxicity, in human and macaque CDH3 assay systems. Advantageously, the present invention provides CDH3×CD3 bispecific antibody constructs that show T cell-mediated cytotoxicity in human and macaque. This advantage is achieved by CDH3×CD3 bispecific antibody constructs that bind to an epitope cluster comprised within amino acid positions 291-363 (SEQ ID NO: 36) of human CDH3.

It must be noted that as used herein, the singular forms "a", "an", and "the" include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

The term "antibody construct" refers to a molecule in which the structure and/or function is/are based on the structure and/or function of an antibody, e.g., of a full-length or whole immunoglobulin molecule. An antibody construct is hence capable of binding to its specific target or antigen. Furthermore, an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. The antibodies on which the constructs according to the invention are based include for example monoclonal, recombinant, chimeric, deimmunized, humanized and human antibodies.

Within the definition of "antibody constructs" according to the invention are full-length or whole antibodies including camelid antibodies and other immunoglobulin antibodies generated by biotechnological or protein engineering methods or processes. These full-length antibodies may be for example monoclonal, recombinant, chimeric, deimmunized, humanized and human antibodies.

Also within the definition of "antibody constructs" are fragments of full-length antibodies, such as VH, VHH, VL, (s)dAb, Fv, Fd, Fab, Fab', F(ab')2 or "r IgG" ("half antibody"). Antibody constructs according to the invention may also be modified fragments of antibodies, also called antibody variants, such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)$_2$, (scFv-CH3)$_2$, ((scFv)$_2$-CH3+CH3), ((scFv)$_2$-CH3) or (scFv-CH3-scFv)$_2$, multibodies such as triabodies or tetrabodies, and single domain antibodies such as nanobodies or single variable domain antibodies comprising merely one variable domain, which might be VHH, VH or VL, that specifically bind an antigen or epitope independently of other V regions or domains.

Furthermore, the definition of the term "antibody constructs" includes monovalent, bivalent and polyvalent/multivalent constructs and, thus, monospecific constructs, specifically binding to only one antigenic structure, as well as bispecific and polyspecific/multispecific constructs, which specifically bind more than one antigenic structure, e.g. two, three or more, through distinct binding domains. Moreover, the definition of the term "antibody constructs" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore system can be used to increase the efficiency of phage antibodies which bind to an epitope of a target antigen, such as CDH3 or CD3 epsilon (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chinmeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetical diversity can be increased by chain shuffling. Two or three rounds of mutation and selection using display methods like phage display usually results in antibody fragments with affinities in the low nanomolar range.

A preferred type of an amino acid substitutional varianation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human CDH3. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct or antibody fragment may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class I1 binding peptides can be searched for motifs present in the VH and VL sequences, as described in WO 98/52976 and WO 00/34317. These motifs bind to any of the 18 major MHC class I1 DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fe), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes.

Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse.

In some embodiments, the antibody constructs of the invention are "isolated" or "substantially pure" antibody constructs. "Isolated" or "substantially pure" when used to describe the antibody construct disclosed herein means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target site on the target molecules (antigens) CDH3 and CD3, respectively. The structure and function of the first binding domain (recognizing CDH3), and preferably also the structure and/or function of the second binding domain (CD3), is/are based on the structure and/or function of an antibody, e.g. of a full-length or whole immunoglobulin molecule. According to the invention, the first binding domain is characterized by the presence of three light chain CDRs (i.e. CDR1, CDR2 and CDR3 of the VL region) and three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are preferably in the form of polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids). The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

As mentioned above, a binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Examples of (modified) antigen-binding antibody fragments include (1) a Fab fragment, a monovalent fragment having the VL, VH, CL and CH1 domains; (2) a F(ab')$_2$ fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, WO 2014/144722, WO 2014/151910, and WO 2015/048272.

Preferably the binding domain which binds to CDH3 and/or the binding domain which binds to CD3 is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first XenoMouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430,938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023,010 to Krimpenfort and Berns, U.S. Pat. Nos. 5,612,205; 5,721,367; and 5,789,215 to Berns et al., and U.S. Pat. No. 5,643,763 to Choi and Dunn, and GenPharm International U.S. patent application Ser. No. 07/574,748, Ser. No.

07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161,739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a fully human binding domain against CDH3 and a fully human binding domain against CD3 in order to vitiate concerns and/or effects of HAMA or HACA response.

The terms "(specifically) binds to", (specifically) recognizes", "is (specifically) directed to", and "(specifically) reacts with" mean in accordance with this invention that a binding domain interacts or specifically interacts with one or more, preferably at least two, more preferably at least three and most preferably at least four amino acids of an epitope located on the target protein or antigen (CDH3/CD3).

The term "epitope" refers to a site on an antigen to which a binding domain, such as an antibody or immunoglobulin or derivative or fragment of an antibody or of an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence, and can also be longer and comprise at least 15 or 20 amino acids, at least 25 or 30 amino acids, or even more.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigen for one of the binding domains is comprised within the CDH3 protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

The provided examples describe a further method to characterize a given binding domain, which includes a test whether the given binding domain binds to one or more epitope(s) of a given protein, in particular CDH3.

As used herein, the term "epitope cluster" denotes epitopes lying in a defined contiguous stretch of an antigen. An epitope cluster can comprise one, two or more epitopes. An antibody construct can also bind to an epitope within an epitope cluster and in addition to a further epitope outside of this cluster, which could then correspond to a discontinuous epitope. A discontinuous epitope is usually characterized in that it encompasses amino acid stretches of the antigen that are not contiguous. For example, an antibody construct could bind to the extracellular subdomains D3A and D3C, but not to D3B. The concept of "epitope clustering" is also used in the characterization of the features of the antibody constructs of the invention. The epitope clusters and the epitopes that were defined—in the context of the present invention—in the extracellular domain of CDH3 are described above and depicted in FIG. 1.

When an extracellular domain (D1-D5) or a sub-domain (A, B, C) thereof in the human CDH3 protein is exchanged with the respective extracellular domain (D1-D5) or a sub-domain (A, B, C) thereof of a non-human and non-primate (e.g. chicken or mouse) CDH3 antigen (resulting in a construct comprising human CDH3, wherein one human extracellular domain or sub-domain thereof is replaced with its counterpart non-human extracellular domain or sub-domain thereof), a decrease in the binding of the binding domain will occur. Said decrease is preferably at least 10%, 20%, 30%, 40%, 50%; more preferably at least 60%, 70%, 80%, 90%, 95% or even 100% in comparison to the respective epitope cluster in the human CDH3 protein, whereby binding to the respective extracellular domain (D1-D5) or sub-domain thereof in the human CDH3 protein is set to be 100%. It is envisaged that the aforementioned human CDH3/non-human CDH3 chimeras are expressed in CHO cells. It is also envisaged that the human CDH3/non-human CDH3 chimeras are fused with a transmembrane domain and/or cytoplasmic domain of a different membrane-bound protein such as EpCAM.

A method to test this loss of binding due to exchange with the respective extracellular domain (D1-D5) or sub-domain thereof of a non-human (e.g., mouse, but others like, rat, hamster, rabbit, chicken etc. might also be conceivable) CDH3 antigen is described in Example 2. A further method to determine the contribution of a specific residue of a target antigen to the recognition by a antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or epitope cluster implies that a binding domain exhibits appreciable affinity for the epitope or epitope cluster on a particular protein or antigen (here: CDH3 and CD3, respectively) and, generally, does not exhibit significant reactivity with proteins or antigens other than CDH3 or CD3. "Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than CDH3 or CD3. Preferably, a binding domain of the invention does not essentially or substantially bind to proteins or antigens other than CDH3 or CD3 (i.e., the first binding domain is not capable of binding to proteins other than CDH3 and the second binding domain is not capable of binding to proteins other than CD3).

The term "does not essentially/substantially bind" or "is not capable of binding" means that a binding domain of the present invention does not bind a protein or antigen other than CDH3 or CD3, i.e., does not show reactivity of more than 30%, preferably not more than 20%, more preferably not more than 10%, particularly preferably not more than 9%, 8%, 7%, 6% or 5% with proteins or antigens other than CDH3 or CD3, whereby binding to CDH3 or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

In another aspect, the present invention provides a bispecific antibody construct comprising a first preferably human binding domain which binds to human CDH3 on the surface of a target cell and a second preferably human binding domain which binds to human CD3 on the surface of a T cell, wherein the first binding domain comprises a VH region comprising CDR-H1, CDR-H2 and CDR-H3 and a VL region comprising CDR-L1, CDR-L2 and CDR-L3 selected from the group consisting of:
  a) CDR-H1 as depicted in SEQ ID NO: 149, CDR-H2 as depicted in SEQ ID NO: 150, CDR-H3 as depicted in SEQ ID NO: 151, CDR-L1 as depicted in SEQ ID NO: 152, CDR-L2 as depicted in SEQ ID NO: 153 and CDR-L3 as depicted in SEQ ID NO: 154;
  b) CDR-H1 as depicted in SEQ ID NO: 159, CDR-H2 as depicted in SEQ ID NO: 160, CDR-H3 as depicted in SEQ ID NO: 161, CDR-L1 as depicted in SEQ ID NO: 162, CDR-L2 as depicted in SEQ ID NO: 163 and CDR-L3 as depicted in SEQ ID NO: 164;
  c) CDR-H1 as depicted in SEQ ID NO: 169, CDR-H2 as depicted in SEQ ID NO: 170, CDR-H3 as depicted in SEQ ID NO: 171, CDR-L1 as depicted in SEQ ID NO: 172, CDR-L2 as depicted in SEQ ID NO: 173 and CDR-L3 as depicted in SEQ ID NO: 174;
  d) CDR-H1 as depicted in SEQ ID NO: 179, CDR-H2 as depicted in SEQ ID NO: 180, CDR-H3 as depicted in SEQ ID NO: 181, CDR-L1 as depicted in SEQ ID NO: 182, CDR-L2 as depicted in SEQ ID NO: 183 and CDR-L3 as depicted in SEQ ID NO: 184;
  e) CDR-H1 as depicted in SEQ ID NO: 189, CDR-H2 as depicted in SEQ ID NO: 190, CDR-H3 as depicted in SEQ ID NO: 191, CDR-L1 as depicted in SEQ ID NO: 192, CDR-L2 as depicted in SEQ ID NO: 193 and CDR-L3 as depicted in SEQ ID NO: 194;
  f) CDR-H1 as depicted in SEQ ID NO: 199, CDR-H2 as depicted in SEQ ID NO: 200, CDR-H3 as depicted in SEQ ID NO: 201, CDR-L1 as depicted in SEQ ID NO: 202, CDR-L2 as depicted in SEQ ID NO: 203 and CDR-L3 as depicted in SEQ ID NO: 204;
  g) CDR-H1 as depicted in SEQ ID NO: 209, CDR-H2 as depicted in SEQ ID NO: 210, CDR-H3 as depicted in SEQ ID NO: 211, CDR-L1 as depicted in SEQ ID NO: 212, CDR-L2 as depicted in SEQ ID NO: 213 and CDR-L3 as depicted in SEQ ID NO: 214;
  h) CDR-H1 as depicted in SEQ ID NO: 219, CDR-H2 as depicted in SEQ ID NO: 220, CDR-H3 as depicted in SEQ ID NO: 221, CDR-L1 as depicted in SEQ ID NO: 222, CDR-L2 as depicted in SEQ ID NO: 223 and CDR-L3 as depicted in SEQ ID NO: 224;
  i) CDR-H1 as depicted in SEQ ID NO: 229, CDR-H2 as depicted in SEQ ID NO: 230, CDR-H3 as depicted in SEQ ID NO: 231, CDR-L1 as depicted in SEQ ID NO: 232, CDR-L2 as depicted in SEQ ID NO: 233 and CDR-L3 as depicted in SEQ ID NO: 234; and
  j) CDR-H1 as depicted in SEQ ID NO: 239, CDR-H2 as depicted in SEQ ID NO: 240, CDR-H3 as depicted in SEQ ID NO: 241, CDR-L1 as depicted in SEQ ID NO: 242, CDR-L2 as depicted in SEQ ID NO: 243 and CDR-L3 as depicted in SEQ ID NO: 244.

In another aspect, the present invention provides a bispecific antibody construct comprising a first preferably human binding domain which binds to human CDH3 on the surface of a target cell and a second preferably human binding domain which binds to human CD3 on the surface of a T cell, wherein the first binding domain comprises a VH region comprising CDR-H1, CDR-H2 and CDR-H3 and a VL region comprising CDR-L1, CDR-L2 and CDR-L3 selected from the group consisting of:
  a) CDR-H1 as depicted in SEQ ID NO: 279, CDR-H2 as depicted in SEQ ID NO: 280, CDR-H3 as depicted in SEQ ID NO: 281, CDR-L1 as depicted in SEQ ID NO: 282, CDR-L2 as depicted in SEQ ID NO: 283 and CDR-L3 as depicted in SEQ ID NO: 284;
  b) CDR-H1 as depicted in SEQ ID NO: 289, CDR-H2 as depicted in SEQ ID NO: 290, CDR-H3 as depicted in SEQ ID NO: 291, CDR-L1 as depicted in SEQ ID NO: 292, CDR-L2 as depicted in SEQ ID NO: 293 and CDR-L3 as depicted in SEQ ID NO: 294;
  c) CDR-H1 as depicted in SEQ ID NO: 299, CDR-H2 as depicted in SEQ ID NO: 300, CDR-H3 as depicted in SEQ ID NO: 301, CDR-L1 as depicted in SEQ ID NO: 302, CDR-L2 as depicted in SEQ ID NO: 303 and CDR-L3 as depicted in SEQ ID NO: 304;
  d) CDR-H1 as depicted in SEQ ID NO: 309, CDR-H2 as depicted in SEQ ID NO: 310, CDR-H3 as depicted in SEQ ID NO: 311, CDR-L1 as depicted in SEQ ID NO: 312, CDR-L2 as depicted in SEQ ID NO: 313 and CDR-L3 as depicted in SEQ ID NO: 314;

e) CDR-H1 as depicted in SEQ ID NO: 319, CDR-H2 as depicted in SEQ ID NO: 320, CDR-H3 as depicted in SEQ ID NO: 321, CDR-L1 as depicted in SEQ ID NO: 322, CDR-L2 as depicted in SEQ ID NO: 323 and CDR-L3 as depicted in SEQ ID NO: 324;
f) CDR-H1 as depicted in SEQ ID NO: 329, CDR-H2 as depicted in SEQ ID NO: 330, CDR-H3 as depicted in SEQ ID NO: 331, CDR-L1 as depicted in SEQ ID NO: 332, CDR-L2 as depicted in SEQ ID NO: 333 and CDR-L3 as depicted in SEQ ID NO: 334;
g) CDR-H1 as depicted in SEQ ID NO: 339, CDR-H2 as depicted in SEQ ID NO: 340, CDR-H3 as depicted in SEQ ID NO: 341, CDR-L1 as depicted in SEQ ID NO: 342, CDR-L2 as depicted in SEQ ID NO: 343 and CDR-L3 as depicted in SEQ ID NO: 344; and
h) CDR-H1 as depicted in SEQ ID NO: 349, CDR-H2 as depicted in SEQ ID NO: 350, CDR-H3 as depicted in SEQ ID NO: 351, CDR-L1 as depicted in SEQ ID NO: 352, CDR-L2 as depicted in SEQ ID NO: 353 and CDR-L3 as depicted in SEQ ID NO: 354.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site. The CH domain most proximal to VH is designated as CH1. Each light (L) chain is linked to a heavy (H) chain by one covalent disulfide bond, while the two H chains are linked to each other by one or more disulfide bonds depending on the H chain isotype.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.). The constant domains are not directly involved in antigen binding, but exhibit various effector functions, such as, for example, antibody-dependent, cell-mediated cytotoxicity and complement activation.

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding site is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding site. H3, for example, can be as short as two amino acid residues or greater than 26 amino acids.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

In one embodiment, the first binding domain of the antibody construct of the invention comprises a VH region selected from the group consisting of VH regions as depicted in as depicted in SEQ ID NO: 155, SEQ ID NO: 165, SEQ ID NO: 175, SEQ ID NO: 185, SEQ ID NO: 195, SEQ ID NO: 205, SEQ ID NO: 215, SEQ ID NO: 225, SEQ ID NO: 235, and SEQ ID NO: 245.

In a further embodiment of the antibody construct of the invention, the first binding domain comprises a VL region selected from the group consisting of VL regions as depicted in SEQ 1D NO: 156, SEQ ID NO: 166, SEQ ID NO: 176, SEQ ID NO: 186, SEQ ID NO: 196, SEQ ID NO: 206, SEQ ID NO: 216, SEQ ID NO: 226, SEQ ID NO: 236, and SEQ ID NO: 246.

In another embodiment of the antibody construct of the invention, the first binding domain comprises a VH region and a VL region selected from the group consisting of pairs of a VH region and a VL region as depicted in SEQ ID NO: 155+156, SEQ ID NO: 165+166, SEQ ID NO: 175+176, SEQ ID NO: 185+186, SEQ ID NO: 195+196, SEQ ID NO: 205+206, SEQ ID NO: 215+216, SEQ ID NO: 225+226, SEQ ID NO: 235+236, and SEQ ID NO: 245+246.

In another embodiment of the antibody construct of the invention, the first binding domain of the antibody construct of the invention comprises a VH region selected from the group consisting of VH regions as depicted in SEQ ID NO: 285, SEQ ID NO: 295, SEQ ID NO: 305, SEQ ID NO: 315, SEQ ID NO: 325, SEQ ID NO: 335, SEQ ID NO: 345, and SEQ ID NO: 355.

In a further embodiment of the antibody construct of the invention, the first binding domain comprises a VL region selected from the group consisting of VL regions as depicted in SEQ ID NO: 286, SEQ ID NO: 296, SEQ ID NO: 306, SEQ ID NO: 316, SEQ ID NO: 326, SEQ ID NO: 336, SEQ ID NO: 346, and SEQ ID NO: 356.

In another embodiment of the antibody construct of the invention, the first binding domain comprises a VH region and a VL region selected from the group consisting of pairs of a VH region and a VL region as depicted in SEQ ID NO: 285+286, SEQ ID NO: 295+296, SEQ ID NO: 305+306, SEQ ID NO: 315+316, SEQ ID NO: 325+326, SEQ ID NO: 335+336, SEQ ID NO: 345+346, and SEQ ID NO: 355+356.

The term "bispecific" as used herein refers to an antibody construct which is "at least bispecific", i.e., it comprises at least a first binding domain and a second binding domain, wherein the first binding domain binds to one antigen or target (here: CDH3), and the second binding domain binds to another antigen or target (here: CD3). Accordingly, antibody constructs according to the invention comprise specificities for at least two different antigens or targets. The term "bispecific antibody construct" of the invention also encompasses multispecific antibody constructs such as trispecific antibody constructs, the latter ones including three binding domains, or constructs having more than three (e.g. four, five . . . ) specificites.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sites with different specificities. Bispecific antibodies can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains of the antibody construct of the present invention may or may not comprise peptide linkers (spacer peptides). The term "peptide linker" defines in accordance with the present invention an amino acid sequence by which the amino acid sequences of one (variable and/or binding) domain and another (variable and/or binding) domain of the antibody construct of the invention are linked with each other. An essential technical feature of such peptide linker is that it does not comprise any polymerization activity. Among the suitable peptide linkers are those described in U.S. Pat. Nos. 4,751,180 and 4,935,233 or WO 88/09344.

In the event that a linker is used, this linker is preferably of a length and sequence sufficient to ensure that each of the first and second domains can, independently from one another, retain their differential binding specificities. For peptide linkers which connect the at least two binding domains in the antibody construct of the invention (or two variable domains), those peptide linkers are preferred which comprise only a few number of amino acid residues, e.g. 12 amino acid residues or less. Thus, peptide linker of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A particularly preferred "single" amino acid in context of said "peptide linker" is Gly. Accordingly, said peptide linker may consist of the single amino acid Gly. Another preferred embodiment of a peptide linker is characterized by the amino acid sequence Gly-Gly-Gly-Gly-Ser, i.e. $Gly_4Ser$ (SEQ ID NO: 393), or polymers thereof, i.e. $(Gly_4Ser)x$, where x is an integer of 1 or greater. The characteristics of said peptide linker, which comprise the absence of the promotion of secondary structures are known in the art and are described e.g. in Dall'Acqua et al.

(Biochem. (1998) 37, 9266-9273), Cheadle et al. (Mol Immunol (1992) 29, 21-30) and Raag and Whitlow (FASEB (1995) 9(1), 73-80). Peptide linkers which also do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, N.Y., 2001).

The invention hence provides a preferred embodiment wherein the antibody construct is in a format selected from the group consisting of (scFv)$_2$, scFv-single domain mAb, diabodies and oligomers of any of the afermentioned formats. The term "is in a format" does not exclude that the construct can be further modified, e.g. by attachment or fusion to other moieties, as described herein.

According to a particularly preferred embodiment, the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format (scFv)$_2$ can be engineered by linking two scFv molecules. If these two scFv molecules have the same binding specificity, the resulting (scFv)$_2$ molecule will preferably be called bivalent (i.e. it has two valences for the same target epitope). If the two scFv molecules have different binding specificities, the resulting (scFv)$_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8).

According to a further preferred embodiment of the antibody construct of the invention, the heavy chain (VH) and the light chain (VL) of a binding domain (binding either to the target antigen CDH3 or to CD3) are not directly connected via a peptide linker as described above, but the binding domains are formed as described for the diabody. Thus, the VH of the CD3 binding domain may be fused to the VL of the CDH3 binding domain via a peptide linker, and the VH of the CDH3 binding domain is fused to the VL of the CD3 binding domain via such peptide linker.

Single domain antibodies comprise merely one (monomeric) antibody variable domain which is able to bind selectively to a specific antigen, independently of other V regions or domains. The first single domain antibodies were engineered from heavy chain antibodies found in camelids, and these are called $V_HH$ fragments. Cartilaginous fishes also have heavy chain antibodies (IgNAR) from which single domain antibodies called $V_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)$_2$ is hence a monoclonal antibody construct composed of (at least) two single domain monoclonal antibodies, which are individually selected from the group comprising VH, VL, $V_HH$ and $V_{NAR}$. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

In one embodiment, the first binding domain comprises an amino acid sequence selected from the group consisting of those sequences as depicted in SEQ ID NO: 157, SEQ ID NO: 167, SEQ ID NO: 177, SEQ ID NO: 187, SEQ ID NO: 197, SEQ ID NO: 207, SEQ ID NO: 217, SEQ ID NO: 227, SEQ ID NO: 237, and SEQ ID NO: 247.

In another embodiment, the first binding domain comprises an amino acid sequence selected from the group consisting of those sequences as depicted in SEQ ID NO: 287, SEQ ID NO: 297, SEQ ID NO: 307, SEQ ID NO: 317, SEQ ID NO: 327, SEQ ID NO: 337, SEQ ID NO: 347, and SEQ ID NO: 357.

It is also envisaged that the antibody construct of the invention has, in addition to its function to bind to the target molecules CDH3 and CD3, a further function. In this format, the antibody construct is a trifunctional or multifunctional antibody construct by targeting target cells through binding to CDH3, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as a toxin or radionuclide, and/or means to enhance serum half-life, etc.

Examples for means to extend serum half-life of the antibody constructs of the invention include peptides, proteins or domains of proteins, which are fused or otherwise attached to the antibody constructs. The group of peptides, proteins or protein domains includes peptides binding to other proteins with preferred pharmacokinetic profile in the human body such as serum albumin (see WO 2009/127691). One example of these is represented in SEQ ID NO: 437. An alternative concept of such half-life extending (HLE) peptides includes peptides binding to the neonatal Fc receptor (FcRn, see WO 2007/098420), which are also used in some of the constructs of the present invention. The concept of attaching larger domains of proteins or complete proteins includes e.g. the fusion of human serum albumin, variants or mutants of human serum albumin (see WO2011/051489, WO 2012/059486, WO 2012/150319, WO2013/135896, WO 2014/072481, WO 2013/075066) or domains thereof as well as the fusion of constant region of immunoglobulins (Fc domains) and variants thereof. Such variants of Fc domains may be optimized/modified in order to allow the desired pairing of dimers or mulimers, to abolish Fc receptor binding (e.g. the Fcγ receptor) or for other reasons. If the above described HLE molecules are composed of only one single polypeptide chain, they have the advantage that (i) there is no need for two separate expression systems, and (ii) they can be isolated having a high degree of purity, due to the absence of a "dummy chain". A further concept known in the art to extend the half-life of small protein compounds in the human body is the pegylation of those compounds such as the antibody construct of the present invention.

In a preferred embodiment, the bispecific antibody constructs according to the invention may be linked (e.g. via peptide bond) with a fusion partner (such as a protein or polypeptide or peptide), e.g. for the purpose of extending the construct's serum half-life. These fusion partners can be selected from human serum albumin ("HSA" or "HALB") as wells as sequence variants thereof, peptides binding to HSA, peptides binding to FcRn ("FcRn BP"), or constructs comprising an (antibody derived) Fc region. Exemplary sequences of these fusion partners are depicted in SEQ ID NOs: 406-421 and 437-444. In general, the fusion partners may be linked to the N-terminus or to the C-terminus of the bispecific antibody constructs according to the invention, either directly (e.g. via peptide bond) or through a peptide linker such as (GGGGS)$_n$ (wherein "n" is an integer of 2 or greater, e.g. 2 or 3 or 4). Suitable peptide linkers are depicted in SEQ ID NOs: 392-400. The antibody construct denominated CDH3-13 (full-length sequence of the bispecific molecule as depicted in SEQ ID NO: 178) was linked in frame with a selection of fusion proteins or fusion peptides (see e.g. SEQ ID NOs: 437-444) for the purpose of extending the construct's serum half-life. The respective sequences of these fusion constructs are depicted in SEQ ID NOs: 379-389. The sequences of these fusion partners to the "naked" bispecific antibody construct may as well be linked (C- or N-terminally, in the way it corresponds and it is shown for CDH3-13) to any other of the antibody constructs disclosed herein.

Hence, it is envisaged that the bispecific antibody construct of the invention furthermore comprises a polypeptide as depicted in SEQ ID NO: 437 or an albumin, preferably a human albumin or a variant thereof (having improved properties such as affinities to FcRn receptor and extended plasma half-life), most preferably an albumin as depicted in SEQ ID NO: 443 or 444. These moieties are preferably fused in frame to the C-terminus of the bispecific antibody construct.

Example 15 furthermore shows an unexpected advantage that the C-terminal fusion of an albumin to a bispecific antibody construct of the invention involves. For those bispecific T cell engaging molecules comprising a binding domain specific for the human and *Callithrix jacchus, Saguinus oedipus* or *Saimiri sciureus* CD3ε chain, wherein the epitope is part of an amino acid sequence comprised in the group consisting of SEQ ID NOs: 2, 4, 6, or 8 of WO 2008/119567 and comprises at least the amino acid sequence Gln-Asp-Gly-Asn-Glu, it was observed that those molecules—when used in very high concentrations—showed T cell cytotoxicity even in the absence of target cells. Such high concentration issues may become relevant for specific administration routes or in combination with specific target settings and required compound concentrations. Preferred examples of such second binding domains which bind to human CD3 on the surface of a T cell are described herein below and depicted in SEQ ID NOs: 445-537. When a serum albumin is fused to the C-terminus of such bispecific construct, T cell cytotoxicity is avoided, see FIG. 13. Without the intention to be bound by theory, the activation of T cells in the presence of a high concentration of T cell engaging bispecific antibody constructs and in the absence of target cells may be explained by dimerization or multimerization of the antibody constucts via the CD3 binding domain. Such di- or multimerization is sterically impaired by the fusion of an albumin or variant thereof to the C terminus of the antibody construct, while maintaining the characteristics of the antibody construct for its T cell engaging mode of action.

Hence, a preferred antibody construct according to the present invention comprises in an N- to C-terminal order:
  the first binding domain having an amino acid sequence selected from the group consisting of SEQ ID NO: 157, SEQ ID NO: 167, SEQ ID NO: 177, SEQ ID NO: 187, SEQ ID NO: 197, SEQ ID NO: 207, SEQ ID NO: 217, SEQ ID NO: 227, SEQ ID NO: 237, SEQ ID NO: 247, SEQ ID NO: 287, SEQ ID NO: 297, SEQ ID NO: 307, SEQ ID NO: 317, SEQ ID NO: 327, SEQ ID NO: 337, SEQ ID NO: 347, and SEQ ID NO: 357;
  a peptide linker having an amino acid sequence selected from the group consisting of SEQ ID NOs: 392-400;
  the second binding domain having an amino acid sequence selected from the group consisting of SEQ ID NO: 453, SEQ ID NO: 462, SEQ ID NO: 471, SEQ ID NO: 480, SEQ ID NO: 489, SEQ ID NO: 498, SEQ ID NO: 507, SEQ ID NO: 516, SEQ ID NO: 525, SEQ ID NO: 534, and SEQ ID NO: 537; and
  optionally a peptide linker having an amino acid sequence selected from the group consisting of SEQ ID NOs: 392-400; and
  a polypeptide having an amino acid sequence selected from the group consisting of SEQ ID NOs: 437, 443 and 444.

According to another preferred embodiment, the bispecific antibody construct of the invention comprises (in addition to the two binding domains) a third domain which comprises two polypeptide monomers, each comprising a hinge, a CH2 and a CH3 domain, wherein said two polypeptides (or polypeptide monomers) are fused to each other via a peptide linker. Preferably, said third domain comprises in an N- to C-terminal order: hinge-CH2-CH3-linker-hinge-CH2-CH3. Preferred amino acid sequences for said third domain are depicted in SEQ ID NOs: 414-421. Each of said polypeptide monomers preferably has an amino acid sequence that is selected from the group consisting of SEQ ID NOs: 406-413, or that is at least 90% identical to those sequences. In another preferred embodiment, the first and second binding domains of the bispecific antibody construct of the invention are fused to the third domain via a peptide linker which is for example selected from the group consisting of any one of SEQ ID NOs: 392-400, preferably from the group consisting of any one of SEQ ID NOs: 392, 393, 395, 396, 397, 399, and 400.

In line with the present invention, a "hinge" is an IgG hinge region. This region can be identified by analogy using the Kabat numbering, see Kabat positions 223-243. In line with the above, the minimal requirement for a "hinge" are the amino acid residues corresponding to the IgG1 sequence stretch of D231 to P243 according to the Kabat numbering. The terms CH2 and CH3 refer to the immunoglobulin heavy chain constant regions 2 and 3. These regions can as well be identified by analogy using the Kabat numbering, see Kabat positions 244-360 for CH2 and Kabat positions 361-478 for CH3. Is is understood that there is some variation between the immunoglobulins in terms of their IgG1 Fc region, IgG2 Fc region, IgG3 Fc region, IgG4 Fc region, IgM Fc region, IgA Fc region, IgD Fc region and IgE Fc region (see, e.g., Padlan, Molecular Immunology, 31(3), 169-217 (1993)). The term Fc monomer refers to the last two heavy chain constant regions of IgA, IgD, and IgG, and the last three heavy chain constant regions of IgE and IgM. The Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion of an immunoglobulin may vary, an example for a human IgG heavy chain Fc portion comprising a functional hinge, CH2 and CH3 domain can be defined e.g. to comprise residues D231 (of the hinge domain) to P476 (of the C-terminus of the CH3 domain), or D231 to L476, respectively, for IgG4, wherein the numbering is according to Kabat.

The antibody construct of the invention may hence comprise in an N- to C-terminal order:
(a) the first binding domain;
(b) a peptide linker having an amino acid sequence selected from the group consisting of SEQ ID NOs: 393, 399 and 400;
(c) the second binding domain;
(d) a peptide linker having an amino acid sequence selected from the group consisting of SEQ ID NOs: 392, 393, 395, 396, 397, 399, and 400;
(e) the first polypeptide monomer of the third domain (comprising a hinge, a CH2 and a CH3 domain);
(f) a peptide linker having an amino acid sequence selected from the group consisting of SEQ ID NOs: 402, 403, 404 and 405; and
(g) the second polypeptide monomer of the third domain (comprising a hinge, a CH2 and a CH3 domain).

It is also preferred that the antibody construct of the invention comprises in an N- to C-terminal order:
(a) the first binding domain having an amino acid sequence selected from the group consisting of SEQ ID NO: 157, SEQ ID NO: 167, SEQ ID NO: 177, SEQ ID NO: 187, SEQ ID NO: 197, SEQ ID NO: 207, SEQ ID NO: 217, SEQ ID NO: 227, SEQ ID NO: 237, SEQ ID NO: 247, SEQ ID NO: 287, SEQ ID NO: 297, SEQ ID NO: 307, SEQ ID NO: 317, SEQ ID NO: 327, SEQ ID NO: 337, SEQ ID NO: 347, and SEQ ID NO: 357;
(b) a peptide linker having an amino acid sequence selected from the group consisting of SEQ ID NOs: 393, 399 and 400;
(c) the second binding domain having an amino acid sequence selected from the group consisting of SEQ ID NO: 453, SEQ ID NO: 462, SEQ ID NO: 471, SEQ ID NO: 480, SEQ ID NO: 489, SEQ ID NO: 498, SEQ ID NO: 507, SEQ ID NO: 516, SEQ ID NO: 525, SEQ ID NO: 534, and SEQ ID NO: 537;
(d) a peptide linker having an amino acid sequence selected from the group consisting of SEQ ID NOs: 392, 393, 395, 396, 397, 399, and 400; and
(e) the third domain having an amino acid sequence selected from the group consisting of SEQ ID NOs: 414-421.

Hence, in a preferred embodiment, the antibody construct of the present invention comprises or consists of a polypeptide selected from the group consisting of those depicted in SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, and SEQ ID NO: 435.

Reference is also made to Example 15 showing one of the above described Fc constructs and its anti-tumor activity in a mouse xenograft model.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate. Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}$I or $^{131}$I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for cross-linking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residiues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, *Arch. Biochem. Biophys.* 259:52 and by Edge et al., 1981, *Anal. Biochem.* 118:131. Enzymatic cleavage of carbohydrate moieties on polypeptides can be achieved by the use of a variety of endo- and exo-glycosidases as described by Thotakura et al., 1987, *Meth. Enzymol.* 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

a) isotopic labels, which may be radioactive or heavy isotopes, such as radioisotopes or radionuclides (e.g., $^{3}H$, $^{14}C$, $^{15}N$, $^{35}S$, $^{89}Zr$, $^{90}$, $^{99}Tc$, $^{111}In$, $^{125}$, $^{131}I$)
b) magnetic labels (e.g., magnetic particles)
c) redox active moieties
d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores
e) enzymatic groups (e.g. horseradish peroxidase, 3-galactosidase, luciferase, alkaline phosphatase)
f) biotinylated groups
g) predetermined polypeptide epitopes recognized by a secondary reporter (e.g., leucine zipper pair sequences, binding sites for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus*, or *Aequorea* species of GFP (Chalfie et al., 1994, *Science* 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, *Biotechniques* 24:462-471; Heim et al., 1996, *Curr. Biol.* 6:178-182), enhanced yellow fluorescent protein (EYFP, Clontech Laboratories, Inc.), luciferase (Ichiki et al., 1993, *J. Immunol.* 150:5408-5417), 3 galactosidase (Nolan et al., 1988, *Proc. Natl. Acad. Sci. U.S.A.* 85:2603-2607) and *Renilla* (WO92/15673, WO95/07463, WO98/14605, WO98/26277, WO099/49019, U.S. Pat. Nos. 5,292,658; 5,418,155; 5,683,888; 5,741,668; 5,777,079; 5,804,387; 5,874,304; 5,876,995; 5,925,558).

Leucine zipper domains are peptides that promote oligomerization of the proteins in which they are found. Leucine zippers were originally identified in several DNA-binding proteins (Landschulz et al., 1988, *Science* 240: 1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, *FEBS Letters* 344:191. The use of a modified leucine zipper that allows for stable trimerization of a heterologous protein fused thereto is described in Fanslow et al., 1994, *Semin. Immunol.* 6:267-78. In one approach, recombinant fusion proteins comprising CDH3 antibody fragment or derivative fused to a leucine zipper peptide are expressed in suitable host cells, and the soluble oligomeric CDH3 antibody fragments or derivatives that form are recovered from the culture supernatant.

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs characterized by the identified CDRs are preferred to comprise a His-tag domain, which is generally known as a repeat of consecutive His residues in the amino acid sequence of a molecule, preferably of five, and more preferably of six His residues (hexa-histidine, see SEQ ID NO: 436). The His-tag may be located e.g. at the N- or C-terminus of the antibody construct, preferably it is located at the C-terminus. Most preferably, a hexa-histidine tag (HHHHHH) is linked via peptide bond to the C-terminus of the antibody construct according to the invention.

The first binding domain of the antibody construct of the present invention binds to human CDH3 on the surface of a target cell. The amino acid sequence of human CDH3 is represented by SEQ ID NO: 1. It is understood that the term "on the surface", in the context of the present invention, means that the binding domain specifically binds to an epitope or epitope cluster comprised within the CDH3 extracellular domain (CDH3 ECD). The first binding domain according to the invention hence preferably binds to CDH3 when it is expressed by naturally expressing cells or cell lines, and/or by cells or cell lines transformed or (stably/transiently) transfected with CDH3. In a preferred embodiment the first binding domain also binds to CDH3 when CDH3 is used as a "target" or "ligand" molecule in an in vitro binding assay such as BIAcore or Scatchard. The "target cell" can be any prokaryotic or eukaryotic cell expressing CDH3 on its surface; preferably the target cell is a cell that is part of the human or animal body, such as a tumor or cancer cell.

The term "CDH3 ECD" refers to a form of CDH3 which is essentially free of transmembrane and cytoplasmic domains of CDH3. It will be understood by the skilled artisan that the transmembrane domain identified for the CDH3 polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein. A preferred human CDH3 ECD is shown in SEQ ID NO: 3.

The affinity of the first binding domain for human CDH3 is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM. The affinity can be measured for example in a BIAcore assay or in a Scatchard assay, e.g. as described in the Examples. Other methods of determining the affinity are well-known to the skilled person.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (α) and beta (β) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3γ (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The most preferred CD3 binding epitope corresponds to amino acid residues 1-27 of the human CD3 epsilon extracellular domain.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by CDH3/CD3 bispecific antibody constructs can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque CDH3, the effector cells should also be of macaque origin such as a macaque T cell line, e.g. 4119LnPx. The target cells should express (at least the extracellular domain of) CDH3, e.g. human or macaque CDH3. Target cells can be a cell line (such as CHO) which is stably or transiently transfected with CDH3, e.g. human or macaque CDH3. Alternatively, the target cells can be a CDH3 positive natural expresser cell line. Usually EC50 values are expected to be lower with target cell lines expressing higher levels of CDH3 on the cell surface. The effector to target cell (E:T) ratio is usually about 10:1, but can also vary. Cytotoxic activity of CDH3/CD3 bispecific antibody constructs can be measured in a 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by CDH3/CD3 bispecific antibody constructs of the present invention is preferably measured in a cell-based cytotoxicity assay. It may also be measured in a 51-chromium release assay. It is represented by the $EC_{50}$ value, which corresponds to the half maximal effective concentration (concentration of the antibody construct which induces a cytotoxic response halfway between the baseline and maximum). Preferably, the $EC_{50}$ value of the CDH3×CD3 bispecific antibody constructs is ≤5000 pg/ml or ≤4000 pg/ml, more preferably ≤3000 pg/ml or ≤2000 pg/ml, even more preferably ≤1000 pg/ml or ≤500 pg/ml, even more preferably ≤400 pg/ml or ≤300 pg/ml, even more preferably ≤200 pg/ml, even more preferably ≤100 pg/ml, even more preferably ≤50 pg/ml, even more preferably ≤20 pg/ml or ≤10 pg/ml, and most preferably ≤5 pg/ml.

The above given $EC_{50}$ values can be measured in different assays. The skilled person is aware that an EC50 value can be expected to be lower when stimulated/enriched CD8+ T cells are used as effector cells, compared with unstimulated PBMC. It can furthermore be expected that the EC50 values are lower when the target cells express a high number of the target antigen compared with a low target expression rat. For example, when stimulated/enriched human CD8+ T cells are used as effector cells (and either CDH3 transfected cells such as CHO cells or a CDH3 positive natural expresser cell line such as A431 are used as target cells), the $EC_{50}$ value of the CDH3×CD3 bispecific antibody construct is preferably ≤1000 pg/ml, more preferably ≤500 pg/ml, even more preferably ≤250 pg/ml, even more preferably ≤100 pg/ml, even more preferably ≤50 pg/ml, even more preferably ≤10 pg/ml, and most preferably ≤5 pg/ml. When human PBMCs are used as effector cells, the $EC_{50}$ value of the CDH3×CD3 bispecific antibody construct is preferably ≤5000 pg/ml or ≤4000 pg/ml (in particular when the target cells are a CDH3 positive natural expresser cell line such as A431), more preferably ≤2000 pg/ml (in particular when the target cells are CDH3 transfected cells such as CHO cells), more preferably ≤1000 pg/ml or ≤500 pg/ml, even more preferably ≤200 pg/ml, even more preferably ≤150 pg/ml, even more preferably ≤100 pg/ml, and most preferably ≤50 pg/ml, or lower. When a macaque T cell line such as LnPx4119 is used as effector cells, and a macaque CDH3 transfected cell line such as CHO cells is used as target cell line, the $EC_{50}$ value of the CDH3×CD3 bispecific antibody construct is preferably ≤2000 pg/ml or ≤1500 pg/ml, more preferably ≤1000 pg/ml or ≤500 pg/ml, even more preferably ≤300 pg/ml or ≤250 pg/ml, even more preferably ≤100 pg/ml, and most preferably ≤50 pg/ml.

Preferably, the CDH3/CD3 bispecific antibody constructs of the present invention do not induce/mediate lysis or do not essentially induce/mediate lysis of CDH3 negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of CDH3 negative cells, whereby lysis of a CDH3 positive cell line such as A431 is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual CDH3/CD3 bispecific antibody constructs is referred to as "potency gap". This potency gap can e.g. be calculated as ratio between EC$_{50}$ values of the molecule's monomeric and dimeric form. Potency gaps of the CDH3/CD3 bispecific antibody constructs of the present invention are preferably ≤5, more preferably ≤4, even more preferably ≤3, even more preferably ≤2 and most preferably ≤1. As an example, the potency gap for CDH3-13 was determined to be 0.5, the potency gap for CDH3-13×CD3-HLE (Fc) was determined to be 0.9, the potency gap for CDH3-25 was determined to be 0.7, and the potency gap for CDH3-25×CD3-HALB was as well determined to be 0.7.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human CDH3 and human CD3, respectively, will also bind to CDH3/CD3 of primates including (but not limited to) new world primates (such as *Callithrix jacchus, Saguinus Oedipus* or *Saimiri sciureus*), old world primates (such baboons and macaques), gibbons, and non-human homininae.

In one aspect of the invention, the first binding domain binds to human CDH3 and further binds to macaque CDH3, such as CDH3 of *Macaca fascicularis* (SEQ ID NO: 5), and more preferably, to macaque CDH3 ECD. The affinity of the first binding domain for macaque CDH3 is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding macaque CDH3 versus human CDH3 [ma CDH3:hu CDH3] (as determined e.g. by BiaCore or by Scatchard analysis, see Examples) is between 0.1 and 10, more preferably between 0.2 and 5, even more preferably between 0.3 and 2.5, even more preferably between 0.4 and 2, and most preferably between 0.5 and 1.

In one embodiment of the antibody construct of the invention, the second binding domain binds to human and *Callithrix jacchus, Saguinus Oedipus* or *Saimiri sciureus* CD3 epsilon. Preferably, the second binding domain binds to an extracellular epitope of these CD3 epsilon chains. It is also envisaged that the second binding domain binds to an extracellular epitope of the human and the *Macaca* CD3 epsilon chain. The most preferred epitope of CD3 epsilon is comprised within amino acid residues 1-27 of the human CD3 epsilon extracellular domain. Even more specifically, the epitope comprises at least the amino acid sequence Gln-Asp-Gly-Asn-Glu. *Callithrix jacchus* and *Saguinus oedipus* are both new world primate belonging to the family of Callitrichidae, while *Saimiri sciureus* is a new world primate belonging to the family of Cebidae.

It is particularly preferred for the antibody construct of the present invention that the second binding domain which binds to human CD3 on the surface of a T cell comprises a VL region comprising CDR-L1, CDR-L2 and CDR-L3 selected from:

(a) CDR-L1 as depicted in SEQ ID NO: 27 of WO 2008/119567, CDR-L2 as depicted in SEQ ID NO: 28 of WO 2008/119567 and CDR-L3 as depicted in SEQ ID NO: 29 of WO 2008/119567;
(b) CDR-L1 as depicted in SEQ ID NO: 117 of WO 2008/119567, CDR-L2 as depicted in SEQ ID NO: 118 of WO 2008/119567 and CDR-L3 as depicted in SEQ ID NO: 119 of WO 2008/119567; and
(c) CDR-L1 as depicted in SEQ ID NO: 153 of WO 2008/119567, CDR-L2 as depicted in SEQ ID NO: 154 of WO 2008/119567 and CDR-L3 as depicted in SEQ ID NO: 155 of WO 2008/119567.

In an alternatively preferred embodiment of the antibody construct of the present invention, the second binding domain which binds to human CD3 on the surface of a T cell comprises a VH region comprising CDR-H 1, CDR-H2 and CDR-H3 selected from:

(a) CDR-H1 as depicted in SEQ ID NO: 12 of WO 2008/119567, CDR-H2 as depicted in SEQ ID NO: 13 of WO 2008/119567 and CDR-H3 as depicted in SEQ ID NO: 14 of WO 2008/119567;
(b) CDR-H1 as depicted in SEQ ID NO: 30 of WO 2008/119567, CDR-H2 as depicted in SEQ ID NO: 31 of WO 2008/119567 and CDR-H3 as depicted in SEQ ID NO: 32 of WO 2008/119567;
(c) CDR-H1 as depicted in SEQ ID NO: 48 of WO 2008/119567, CDR-H2 as depicted in SEQ ID NO: 49 of WO 2008/119567 and CDR-H3 as depicted in SEQ ID NO: 50 of WO 2008/119567;
(d) CDR-H1 as depicted in SEQ ID NO: 66 of WO 2008/119567, CDR-H2 as depicted in SEQ ID NO: 67 of WO 2008/119567 and CDR-H3 as depicted in SEQ ID NO: 68 of WO 2008/119567;
(e) CDR-H1 as depicted in SEQ ID NO: 84 of WO 2008/119567, CDR-H2 as depicted in SEQ ID NO: 85 of WO 2008/119567 and CDR-H3 as depicted in SEQ ID NO: 86 of WO 2008/119567;
(f) CDR-H1 as depicted in SEQ ID NO: 102 of WO 2008/119567, CDR-H2 as depicted in SEQ ID NO: 103 of WO 2008/119567 and CDR-H3 as depicted in SEQ ID NO: 104 of WO 2008/119567;
(g) CDR-H1 as depicted in SEQ ID NO: 120 of WO 2008/119567, CDR-H2 as depicted in SEQ ID NO: 121 of WO 2008/119567 and CDR-H3 as depicted in SEQ ID NO: 122 of WO 2008/119567;
(h) CDR-H1 as depicted in SEQ ID NO: 138 of WO 2008/119567, CDR-H2 as depicted in SEQ ID NO: 139 of WO 2008/119567 and CDR-H3 as depicted in SEQ ID NO: 140 of WO 2008/119567;
(i) CDR-H1 as depicted in SEQ ID NO: 156 of WO 2008/119567, CDR-H2 as depicted in SEQ ID NO: 157 of WO 2008/119567 and CDR-H3 as depicted in SEQ ID NO: 158 of WO 2008/119567; and
(j) CDR-H1 as depicted in SEQ ID NO: 174 of WO 2008/119567, CDR-H2 as depicted in SEQ ID NO: 175 of WO 2008/119567 and CDR-H3 as depicted in SEQ ID NO: 176 of WO 2008/119567.

It is further preferred for the antibody construct of the present invention that the second binding domain which binds to human CD3 on the surface of a T cell comprises a VL region selected from the group consisting of a VL region as depicted in SEQ ID NO: 35, 39, 125, 129, 161 or 165 of WO 2008/119567.

It is alternatively preferred that the second binding domain which binds to human CD3 on the surface of a T cell comprises a VH region selected from the group consisting of a VH region as depicted in SEQ ID NO: 15, 19, 33, 37, 51, 55, 69, 73, 87, 91, 105, 109, 123, 127, 141, 145, 159, 163, 177 or 181 of WO 2008/119567.

More preferably, the antibody construct of the present invention is characterized by the second binding domain which binds to human CD3 on the surface of a T cell comprising a VL region and a VH region selected from the group consisting of:
- (a) a VL region as depicted in SEQ ID NO: 17 or 21 of WO 2008/119567 and a VH region as depicted in SEQ ID NO: 15 or 19 of WO 2008/119567;
- (b) a VL region as depicted in SEQ ID NO: 35 or 39 of WO 2008/119567 and a VH region as depicted in SEQ ID NO: 33 or 37 of WO 2008/119567;
- (c) a VL region as depicted in SEQ ID NO: 53 or 57 of WO 2008/119567 and a VH region as depicted in SEQ ID NO: 51 or 55 of WO 2008/119567;
- (d) a VL region as depicted in SEQ ID NO: 71 or 75 of WO 2008/119567 and a VH region as depicted in SEQ ID NO: 69 or 73 of WO 2008/119567;
- (e) a VL region as depicted in SEQ ID NO: 89 or 93 of WO 2008/119567 and a VH region as depicted in SEQ ID NO: 87 or 91 of WO 2008/119567;
- (f) a VL region as depicted in SEQ ID NO: 107 or 111 of WO 2008/119567 and a VH region as depicted in SEQ ID NO: 105 or 109 of WO 2008/119567;
- (g) a VL region as depicted in SEQ ID NO: 125 or 129 of WO 2008/119567 and a VH region as depicted in SEQ ID NO: 123 or 127 of WO 2008/119567;
- (h) a VL region as depicted in SEQ ID NO: 143 or 147 of WO 2008/119567 and a VH region as depicted in SEQ ID NO: 141 or 145 of WO 2008/119567;
- (i) a VL region as depicted in SEQ ID NO: 161 or 165 of WO 2008/119567 and a VH region as depicted in SEQ ID NO: 159 or 163 of WO 2008/119567; and
- (j) a VL region as depicted in SEQ ID NO: 179 or 183 of WO 2008/119567 and a VH region as depicted in SEQ ID NO: 177 or 181 of WO 2008/119567.

The above binding domains which bind to human CD3 and are disclosed in WO 2008/119567 are also depicted in present SEQ ID NOs: 445-537.

According to a preferred embodiment of the antibody construct of the present invention, the binding domains and in particular the second binding domain (which binds to human CD3 on the surface of a T cell) have the following format: The pairs of VH regions and VL regions are in the format of a single chain antibody (scFv). The VH and VL regions are arranged in the order VH-VL or VL-VH. It is preferred that the VH-region is positioned N-terminally to a linker sequence, and the VL-region is positioned C-terminally of the linker sequence.

A preferred embodiment of the above described antibody construct of the present invention is characterized by the second binding domain which binds to human CD3 on the surface of a T cell comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567.

In one embodiment of the present invention, the antibody construct has an amino acid sequence selected from the group consisting of those sequences as depicted in SEQ ID NO: 158, SEQ ID NO: 168, SEQ ID NO: 178, SEQ ID NO: 188, SEQ ID NO: 198, SEQ ID NO: 208, SEQ ID NO: 218, SEQ ID NO: 228, SEQ ID NO: 238, and SEQ ID NO: 248.

In another embodiment of the present invention, the antibody construct has an amino acid sequence selected from the group consisting of those sequences as depicted in SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388 and SEQ ID NO: 389.

In another embodiment of the present invention, the antibody construct has an amino acid sequence selected from the group consisting of those sequences as depicted in SEQ ID NO: 288, SEQ ID NO: 298, SEQ ID NO: 308, SEQ ID NO: 318, SEQ ID NO: 328, SEQ ID NO: 338, SEQ ID NO: 348, and SEQ ID NO: 358.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acd sequence modifications should result in an antibody construct which still retains the desired biological activity (binding to CDH3 and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gin, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs. Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. An insertional variant of the antibody construct of the invention includes the fusion to the N-terminus or to the C-terminus of the antibody construct of an enzyme or the fusion to a polypeptide which increases the serum half-life of the antibody construct.

The sites of greatest interest for substitutional mutagenesis include the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions then are refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as CDH3 or CD3 binding.

Generally, if amino acids are substituted in one or more or all of the CDRs of the heavy and/or light chain, it is preferred that the then-obtained "substituted" sequence is at least 60%, more preferably 65%, even more preferably 70%, particularly preferably 75%, more particularly preferably 80% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the antibody construct retains its capability to bind to via the first binding domain and to CD3 or CD3 epsilon via the second binding domain and/or its CDRs have an identity to the then substituted sequence (at least 60%, more preferably 65%, even more preferably 70%, particularly preferably 75%, more particularly preferably 80% identical to the "original" CDR sequence).

Conservative substitutions are shown in Table 1 under the heading of "preferred substitutions". If such substitutions result in a change in biological activity, then more substantial changes, denominated "exemplary substitutions" in Table 1, or as further described below in reference to amino acid classes, may be introduced and the products screened for a desired characteristic.

TABLE 1

Amino acid substitutions

| Original | Exemplary Substitutions | Preferred Substitutions |
| --- | --- | --- |
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gln, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, Adv. Appl. Math. 2:482, the sequence identity alignment algorithm of Needleman and Wunsch, 1970, J Mol. Biol. 48:443, the search for similarity method of Pearson and Lipman, 1988, Proc. Nat. Acad. Sci. U.S.A. 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, Nucl. Acid Res. 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, *J Mol. Evol.* 35:351-360; the method is similar to that described by Higgins and Sharp, 1989, *CABIOS* 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, *J. Mol. Biol.* 215:403-410; Altschul et al., 1997, *Nucleic Acids Res.* 25:3389-3402; and Karin et al., 1993, *Proc. Natl. Acad. Sci. U.S.A.* 90:5873-5787. A particularly useful BLAST program is the WU-BLAST-2 program which was obtained from Altschul et al., 1996, *Methods in Enzymology* 266:460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, *Nucl. Acids Res.* 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 60%, and more typically with preferably increasing homologies or identities of at least 65%, 70%, 75%/o, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" is one with the specified homology, similarity, or identity to the parent CDR of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

In one embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥3 mg/L supernatant.

Likewise, the yield of the dimeric antibody construct isoforms and hence the monomer percentage (i.e., monomer:(monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In a further embodiment, the percentage of identity to human germline of the antibody constructs according to the invention is ≥70% or ≥75%, more preferably ≥80% or ≥85%, even more preferably ≥90%, and most preferably ≥95%. See Example 7. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk/) using Vector NTI software and the amino acid sequence calculated by dividing the identical amino acid residues by the total number of amino acid residues of the VL in percent. The same can be for the VH segments (http://vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In one embodiment, the antibody constructs have a preferred plasma stability (ratio of EC50 with plasma to EC50 w/o plasma) of ≤5, more preferably ≤4 or ≤3.5, even more preferably ≤3 or ≤2.5, and most preferably ≤2 or ≤1.5 or ≤1. The plasma stability of an antibody construct can be tested by incubation of the construct in human plasma at 37° C. for 24 hours followed by EC50 determination in a 51-chromium release cytotoxicity assay. The effector cells in the cytotoxicity assay can be stimulated enriched human CD8 positive T cells. Target cells can e.g. be CHO cells transfected with human CDH3. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control). See Example 11.

It is preferred that the monomer to dimer conversion of antibody constructs of the invention is low. The conversion can be measured under different conditions and analyzed by high performance size exclusion chromatography. For example, incubation of the monomeric isoforms of the antibody constructs can be carried out for 7 days at 37° C. and concentrations of e.g. 100 µg/ml or 250 µg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤1.5%, and most preferably ≤1%. See Example 9.

It is also preferred that the bispecific antibody constructs of the present invention present with very low dimer conversion after a number of freeze/thaw cycles. For example, the antibody construct monomer is adjusted to a concentration of 250 µg/ml in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤1.5%, and most preferably ≤1%, for example after three freeze/thaw cycles.

The bispecific antibody constructs of the present invention preferably show a favorable thermostability with aggregation temperatures above 50° C. or above 52° C., more preferably above 54° C. or above 55° C., even more preferably above 56° C. or above 57° C., and most preferably above 58° C. or above 59° C. The thermostability parameter can be determined in terms of antibody aggregation temperature as follows: Antibody solution at a concentration 250 µg/ml is transferred into a single use cuvette and placed in a Dynamic Light Scattering device. The sample is heated from 40° C. to 70° C. at a heating rate of 0.5° C./min with constant acquisition of the measured radius. Increase of radius indicating melting of the protein and aggregation is used to calculate the aggregation temperature of the antibody. See Example 10.

Alternatively, temperature melting curves can be determined by Differential Scanning Calorimetry (DSC) to determine intrinsic biophysical protein stabilities of the antibody constructs. These experiments are performed using a MicroCal LLC (Northampton, Mass., U.S.A) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

It is furthermore envisaged that the CDH3×CD3 bispecific antibodies of the invention do not cross-react with (i.e., do not bind to) the human CDH3 paralogues CDH1, CDH2, CDH4, and CDH5. Furthermore, it is envisaged that the CDH3×CD3 bispecific antibodies of the invention do not cross-react with (i.e., do not bind to) the macaque/cyno CDH3 paralogues CDH1, CDH2, CDH4, and CDH5. See Example 6.

The CDH3×CD3 bispecific antibodies of the invention are also envisaged to have a turbidity (as measured by OD340 after concentration of purified monomeric antibody to 2.5 mg/ml and over night incubation) of ≤0.1, most preferably of ≤0.05. See Example 12.

In a further embodiment the antibody construct according to the invention is stable at acidic pH. The more tolerant the antibody construct behaves at unphysiologic pH such as pH 5.5 (a pH which is required to run e.g. a cation exchange chromatography), the higher is the recovery of the antibody construct eluted from an ion exchange column relative to the total amount of loaded protein. Recovery of the antibody construct from an ion (e.g., cation) exchange column at pH 5.5 is preferably ≥30%, more preferably ≥40%, more preferably ≥50%, even more preferably ≥60%, even more preferably ≥70%, even more preferably ≥80%, and most preferably ≥90%.

It is furthermore envisaged that the bispecific antibody constructs of the present invention exhibit therapeutic efficacy or anti-tumor activity. This can e.g. be assessed in a study as disclosed in Example 14.

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even f 2.5.

The invention further provides a polynucleotide/nucleic acid molecule encoding an antibody construct of the invention.

A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules).

Transformation can be effected by artificial means. For transformation to happen, cells or bacteria must be in a state of competence, which might occur as a time-limited response to environmental conditions such as starvation and cell density.

Moreover, the invention provides a host cell transformed or transfected with the polynucleotide/nucleic acid molecule or with the vector of the invention.

As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans,* and *K. marxianus; yarrowia* (EP 402 226); *Pichia pastoris* (EP 183 070); *Candida; Trichoderma* reesia (EP 244 234); *Neurospora crassa; Schwanniomyces* such as *Schwanniomyces occidentalis*; and filamentous fungi such as *Neurospora, Penicillium, Tolypocladium,* and *Aspergillus* hosts such as *A. nidulans* and *A. niger.*

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, petunia, tomato, Arabidopsis and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL5 1); TRI cells (Mather et al., *Annals N. Y Acad. Sci.* (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., *Bio/Technology* 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J. T. Baker, Phillipsburg, N.J.) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Moreover, the invention provides a pharmaceutical composition comprising an antibody construct of the invention or an antibody construct produced according to the process of the invention.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A. R. Genrmo, ed.), 1990, Mack Publishing Company). In such embodiments, suitable formulation materials may include, but are not limited to:

amino acids such as glycine, alanine, glutamine, asparagine, threonine, proline, 2-phenylalanine, including charged amino acids, preferably lysine, lysine acetate, arginine, glutamate and/or histidine antimicrobials such as antibacterial and antifungal agents antioxidants such as ascorbic acid, methionine, sodium sulfite or sodium hydrogen-sulfite;

buffers, buffer systems and buffering agents which are used to maintain the composition at physiological pH or at a slightly lower pH, typically within a pH range of from about 5 to about 8 or 9; examples of buffers are borate, bicarbonate, Tris-HCl, citrates, phosphates or other organic acids, succinate, phosphate, histidine and acetate; for example Tris buffer of about pH 7.0-8.5, or acetate buffer of about pH 4.0-5.5;

non-aqueous solvents such as propylene glycol, polyethylene glycol, vegetable oils such as olive oil, and injectable organic esters such as ethyl oleate;

aqueous carriers including water, alcoholic/aqueous solutions, emulsions or suspensions, including saline and buffered media;

biodegradable polymers such as polyesters;

bulking agents such as mannitol or glycine;

chelating agents such as ethylenediamine tetraacetic acid (EDTA);

isotonic and absorption delaying agents;

complexing agents such as caffeine, polyvinylpyrrolidone, beta-cyclodextrin or hydroxypropyl-beta-cyclodextrin)

fillers;

monosaccharides; disaccharides; and other carbohydrates (such as glucose, mannose or dextrins); carbohydrates may be non-reducing sugars, preferably trehalose, sucrose, octasulfate, sorbitol or xylitol;

(low molecular weight) proteins, polypeptides or proteinaceous carriers such as human or bovine serum albumin, gelatin or immunoglobulins, preferably of human origin;

coloring and flavouring agents;

sulfur containing reducing agents, such as glutathione, thioctic acid, sodium thioglycolate, thioglycerol, [alpha]-monothioglycerol, and sodium thio sulfate diluting agents;

emulsifying agents;

hydrophilic polymers such as polyvinylpyrrolidone)

salt-forming counter-ions such as sodium;

preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);

metal complexes such as Zn-protein complexes;

solvents and co-solvents (such as glycerin, propylene glycol or polyethylene glycol);

sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;

suspending agents;

surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are Tween 20, Tween 40, Tween 60, Tween 80 and Tween 85; non-limiting examples for preferred polyethers are PEG 3000, PEG 3350, PEG 4000 and PEG 5000;

stability enhancing agents such as sucrose or sorbitol;

tonicity enhancing agents such as alkali metal halides, preferably sodium or potassium chloride, mannitol sorbitol;

parenteral delivery vehicles including sodium chloride solution, Ringer's dextrose, dextrose and sodium chloride, lactated Ringer's, or fixed oils;

intravenous delivery vehicles including fluid and nutrient replenishers, electrolyte replenishers (such as those based on Ringer's dextrose).

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention might comprise, in addition to the polypeptide of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(–)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized-dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Homing S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters.

Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (*Cancer Immunol. Immunother.* 20 (2005), 1-12).

In one embodiment the invention provides the antibody construct of the invention or the antibody construct produced according to the process of the invention for use in the prevention, treatment or amelioration of a cancer.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having one of the types of (metastatic) tumors or cancers as specified herein, by the administration of an antibody construct according to the invention to a subject in need thereof. Such an improvement may also be seen as a slowing or stopping of the progression of the (metastatic) tumor or cancer of the patient. The term "prevention" as used herein means the avoidance of the occurrence or re-occurrence of a patient having one of the types of (metastatic) tumors or cancers as specified herein, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is an abnormal growth of tissue, usually but not always forming a mass. When also forming a mass, it is commonly referred to as a "tumor". Neoplasms or tumors can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metastatic cancer" encompasses metastases to other tissues or organs than the one of the original tumor. Lymphomas and leukemias are lymphoid neoplasms. For the purposes of the present invention, they are also encompassed by the terms "tumor" or "cancer".

In a preferred embodiment the invention provides the antibody construct of the invention or the antibody construct produced according to the process of the invention for use in the prevention, treatment or amelioration of a cancer, wherein the cancer is selected from the group consisting of lung carcinoma, head and neck carcinoma, a primary or secondary CNS tumor, a primary or secondary brain tumor, primary CNS lymphoma, spinal axis tumors, brain stem glioma, glioblastoma, pituitary adenoma, adrenocortical cancer, esophagus carcinoma, colon cancer, breast cancer, ovarian cancer, NSCLC (non-small cell lung cancer), SCLC (small cell lung cancer), endometrial cancer, cervical cancer, uterine cancer, transitional cell carcinoma, bone cancer, pancreatic cancer, skin cancer, cutaneous or intraocular melanoma, hepatic cancer, biliary duct cancer, gall bladder cancer, kidney cancer, rectal cancer, cancer of the anal region, stomach cancer, gastrointestinal (gastric, colorectal, and duodenal) cancer, cancer of the small intestine, biliary tract cancer, cancer of the urethra, renal cell carcinoma, carcinoma of the endometrium, thyroid cancer, testicular cancer, cutaneous squamous cell cancer, melanoma, stomach cancer, prostate cancer, bladder cancer, osteosarcoma, mesothelioma, Hodgkin's Disease, non hodgkins's lymphoma, chronic or acute leukemia, chronic myeloid leukemia, lymphocytic lymphomas, multiple myeloma, fibrosarcoma, neuroblastoma, retinoblastoma, and soft tissue sarcoma, and a metastatic cancer disease derived from any of the foregoing. The (metastatic) cancer is preferably a P cadherin positive or P cadherin expressing cancer.

In a further preferred embodiment the invention provides the antibody construct of the invention or the antibody construct produced according to the process of the invention for use in the prevention, treatment or amelioration of a cancer, wherein the cancer is a (metastatic) squamous cell carcinoma.

The invention also provides a method for the treatment or amelioration of a (metastatic) tumor or cancer, comprising the step of administering to a subject in need thereof the antibody construct of the invention or the antibody construct produced according to the process of the invention.

In a preferred embodiment the invention provides a method for the treatment or amelioration of a tumor or cancer, wherein the cancer is selected from the group consisting of lung carcinoma, head and neck carcinoma, a primary or secondary CNS tumor, a primary or secondary brain tumor, primary CNS lymphoma, spinal axis tumors, brain stem glioma, pituitary adenoma, adrenocortical cancer, esophagus carcinoma, colon cancer, breast cancer, ovarian cancer, NSCLC (non-small cell lung cancer), SCLC (small cell lung cancer), endometrial cancer, cervical cancer, uterine cancer, transitional cell carcinoma, bone cancer, pancreatic cancer, skin cancer, cutaneous or intraocular melanoma, hepatic cancer, biliary duct cancer, gall bladder cancer, kidney cancer, rectal cancer, cancer of the anal region, stomach cancer, gastrointestinal (gastric, colorectal, and duodenal) cancer, cancer of the small intestine, biliary tract cancer, cancer of the urethra, renal cell carcinoma, carcinoma of the endometrium, thyroid cancer, testicular cancer, cutaneous squamous cell cancer, melanoma, stomach cancer, prostate cancer, bladder cancer, osteosarcoma, mesothelioma, Hodgkin's Disease, non hodgkins's lymphoma, chronic or acute leukemia, chronic myeloid leukemia, lymphocytic lymphomas, multiple myeloma, fibrosarcoma, neuroblastoma, retinoblastoma, and soft tissue sarcoma, and a metastatic cancer disease derived from any of the foregoing, comprising the step of administering to a subject in need thereof the antibody construct of the invention or the antibody construct produced according to the process of the invention.

In a further preferred embodiment the invention provides a method for the treatment or amelioration of a tumor or cancer or a metastatic tumor or cancer, wherein the cancer is a (metastatic) squamous cell carcinoma.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to
   topical routes (such as epicutaneous, inhalational, nasal, opthalmic, auricular/aural, vaginal, mucosal);
   enteral routes (such as oral, gastrointestinal, sublingual, sublabial, buccal, rectal); and
   parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating CDH3-expressing tumors, a therapeutically effective amount of the antibody construct of the invention, e.g. an anti-CDH3/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

In a further embodiment, the invention provides a kit comprising an antibody construct of the invention, an antibody construct produced according to the process of the invention, a vector of the invention, and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

The Figures show:

FIG. 1:

Schematic representation of the five extracellular domains D1-D5 of human CDH3, of murine CDH3 and of one exemplary chimeric CDH3 (here: "D1B murine"). Below are shown again the five domains and further their division into three sub-domains each. The interpretation of an exemplary FACS signal (see "epitope clustering" in Example 2) is shown at the bottom right.

FIG. 2:

Sequence alignment of human CDH3 and murine CDH3 and exemplary indication of the different domains: signal peptide, pro-peptide, extracellular domains D1-D5, transmembrane domain and cytoplasmatic domain. Murine sequence exchanges of the five extracellular domains were introduced into the human CDH3 backbone, see Example 1, and the chimeric constructs were then used for epitope clustering (epitope mapping), see Example 2.

FIG. 3:

Human and murine CDH3 as well as 20 chimeric human-murine CDH3 constructs (five extracellular domains (ECD) and three sub-domains for each ECD) expressed on the surface of CHO cells as shown by flow cytometry. The expression of human wild-type CDH3, murine wild-type CDH3 and of the chimeric CDH3 constructs on CHO cells was verified with a monoclonal mouse IgG1 anti-human CDH3 antibody which is murine cross-reactive. Bound monoclonal antibody was detected with an anti-mouse IgG Fcγ-PE (1:100, 50 µl; Jackson Immunoresearch #115-116-071). D1*): Hu CDH3 D1 mu-CHO.

Figure 4A:
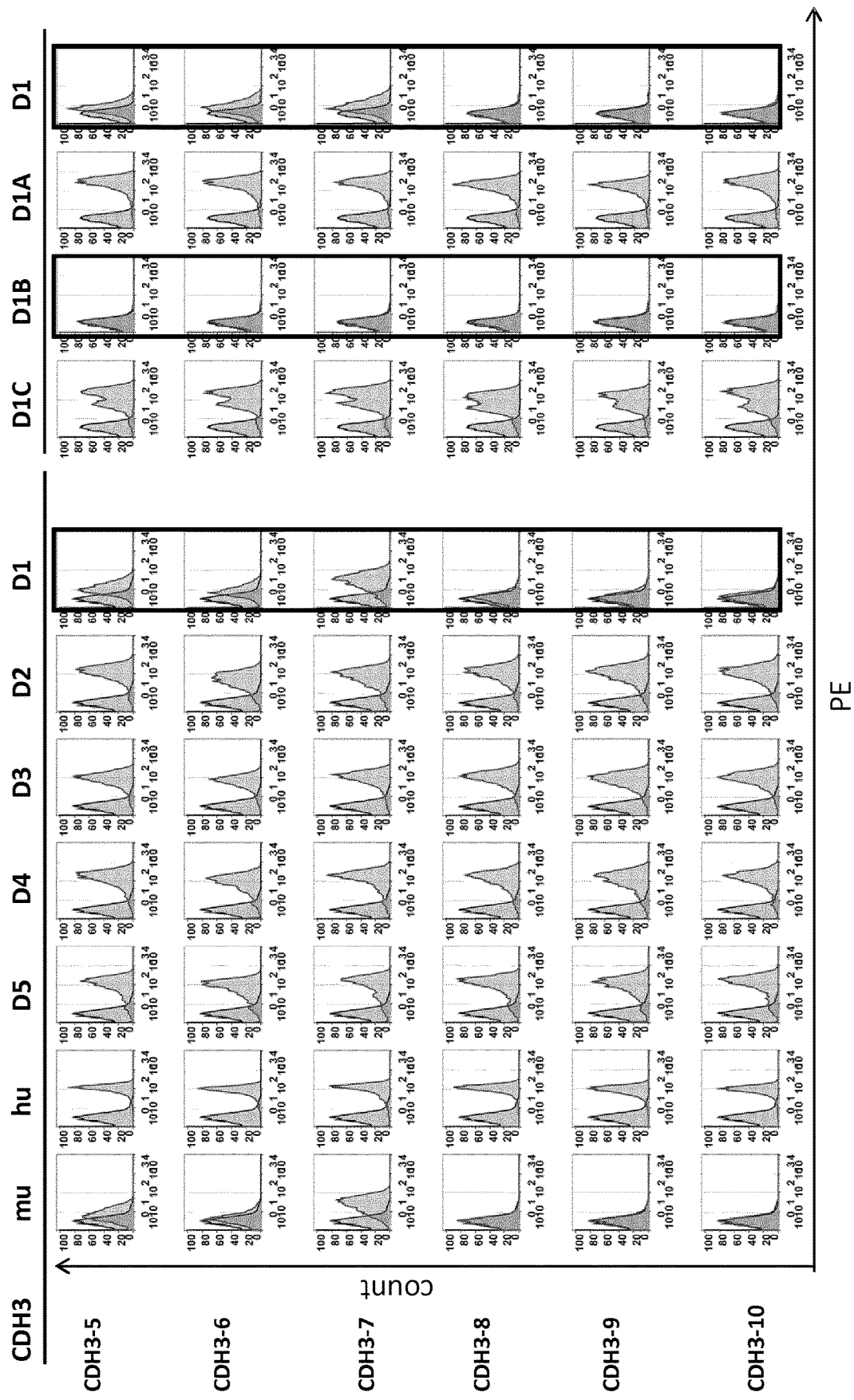
Figure 4B:
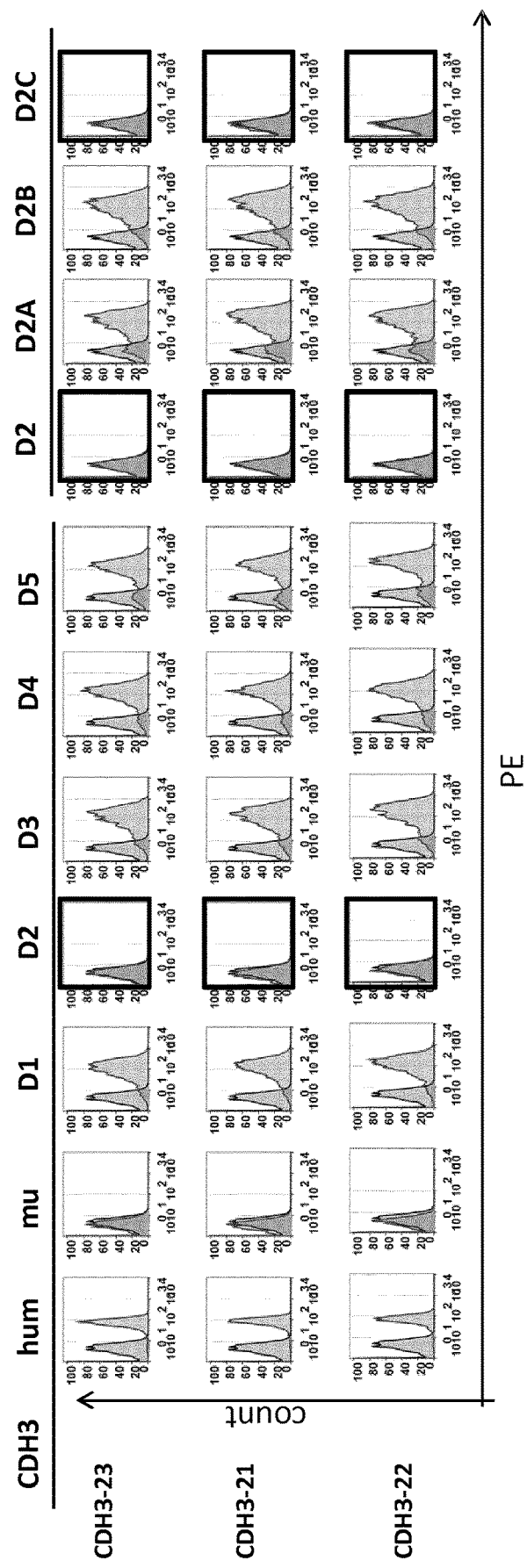
Figure 4C:
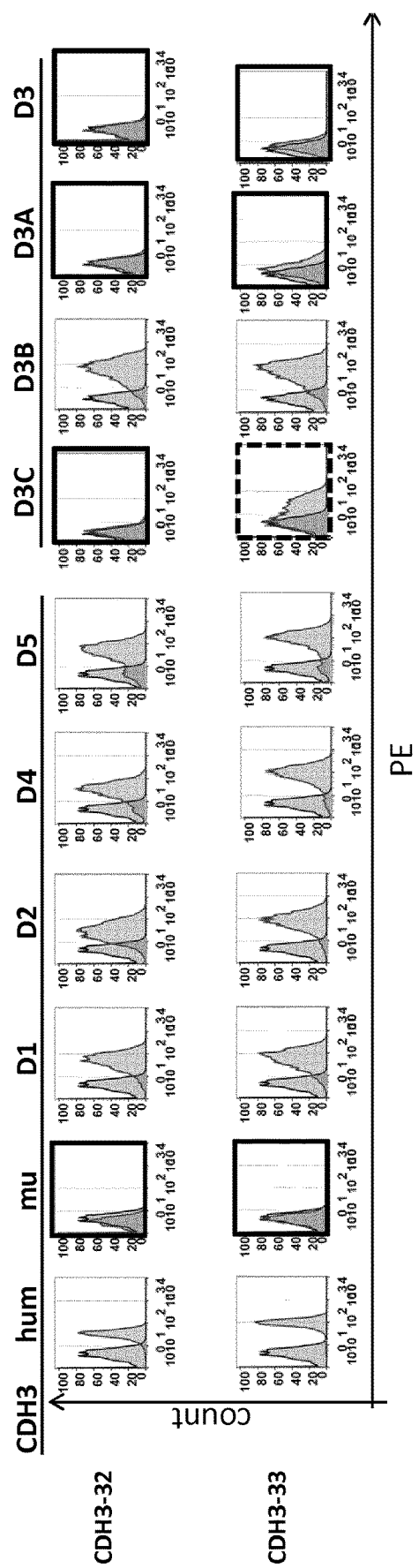

FIG. 4:

Epitope mapping of the CDH3 constructs. Examples of binding molecules specific for different epitope clusters/extracellular sub-domains, as detected by epitope mapping of the chimeric CDH3 constructs, see Example 2. FIG. 4A: D1B binders. FIG. 4B: D2C binders. FIG. 4C: D3A binders.

FIG. 5:

FACS binding analysis of 5 µg/mL purified bispecific antibody monomer on the indicated cell lines. See also Example 5. Detection of the CDH3×CD3 bispecific antibody binding was carried out with an in-house mouse antibody specific for the CD3 binding part of the bispecific antibody, followed by a goat anti mouse Fcγ-PE. Negative control was buffer only, followed by detection antibodies.

FIGS. 5A and 5B:

CDH3×CD3 bispecific binders (FIG. 5A: epitope cluster/extracellular sub-domain D2C; FIG. 5B: epitope cluster/extracellular sub-domain D3A) were analyzed for their binding to human CDH3 transfected CHO cells, human CD3 on the human T cell line HPB-all, cyno CDH3 transfected CHO cells, cyno CD3 on the cyno CD3-expressing T cell line HSC-F, human CDH3 positive cell line A431, and murine CDH3 transfected CHO cells (negative control). Binding was detected in all cases, except for the negative control.

Figure 5D:
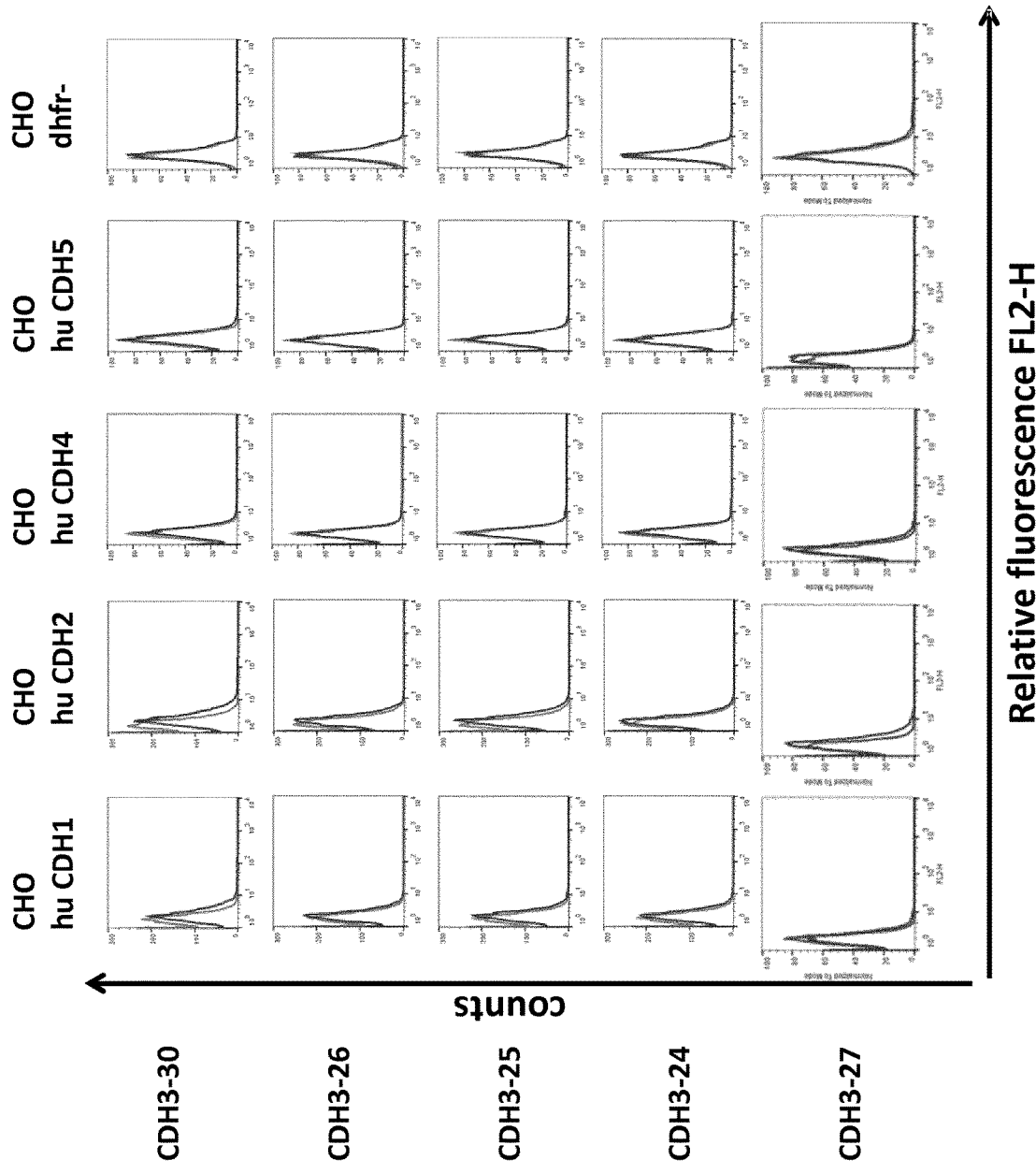

FIGS. 5C and 5D:

CDH3×CD3 bispecific binders (FIG. 5C: epitope cluster/extracellular sub-domain D2C; FIG. 5D: epitope cluster/extracellular sub-domain D3A) were analyzed for their binding to human CDH3 paralogues CDH1, CDH2, CDH4 and CDH5. No binding to the paralogues was detected. No binding to dhfr$^{-/-}$ CHO cells (negative control) was detected.

Figures 6A, 6B:
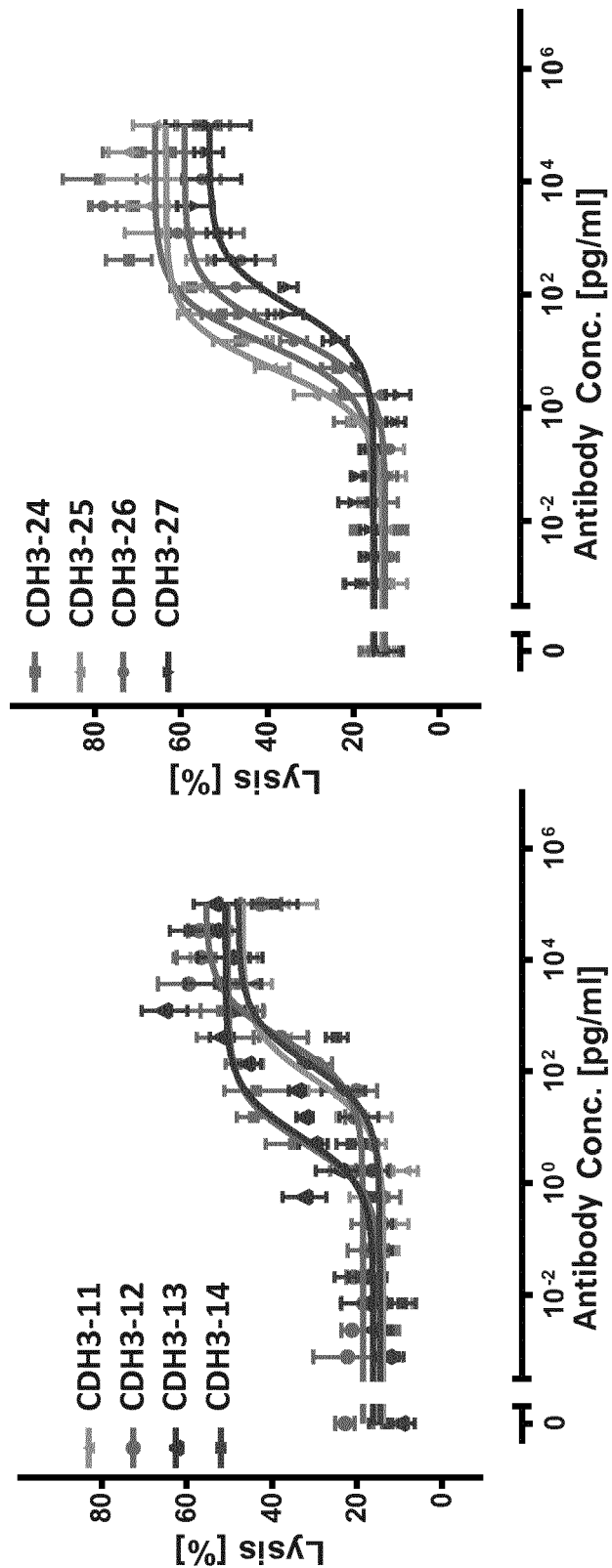

FIG. 6:

Cytotoxic activity of stimulated human CD8+ T cells against human CDH3-transfected CHO cells in the presence of CDH3×CD3 bispecific antibodies as measured in an 18-hour $^{51}$chromium release assay. Effector cells: stimulated enriched human CD8+ T cells. Target cells: Human CDH3 transfected CHO cells. Effector to target cell (E:T) ratio: 10:1. Antibodies specific for epitope cluster/extracellular sub-domain D2C (FIG. 6A) and D3A (FIG. 6B).

Figures 7A, 7B:
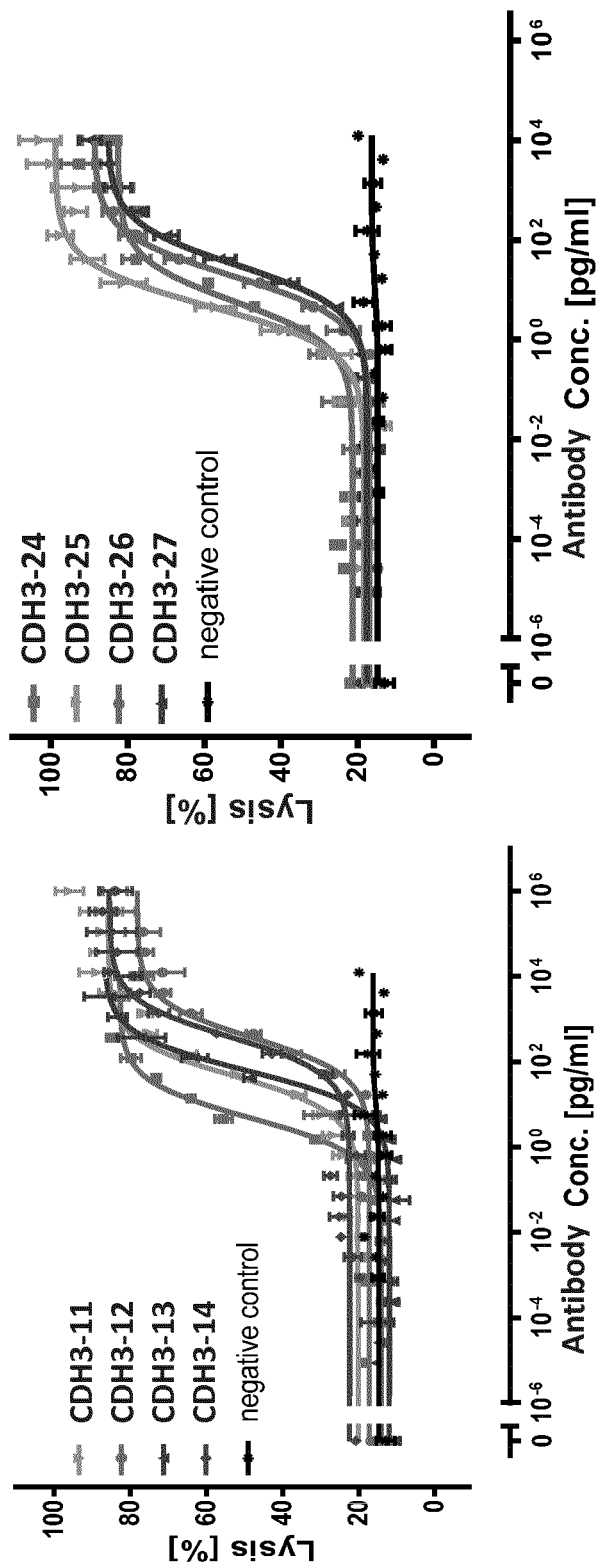

FIG. 7:

Cytotoxic activity of stimulated human CD8+ T cells against the human CDH3 positive epidermoid carcinoma cell line A431 in the presence of CDH3×CD3 bispecific antibodies and as measured in an 18-hour $^{51}$chromium release assay. Effector cells: stimulated enriched human CD8+ T cells. Target cells: human A431 cells. Effector to target cell (E:T) ratio: 10:1. Antibodies specific for epitope cluster/extracellular sub-domain D2C (FIG. 7A) and D3A (FIG. 7B).

Figures 8A, 8B:
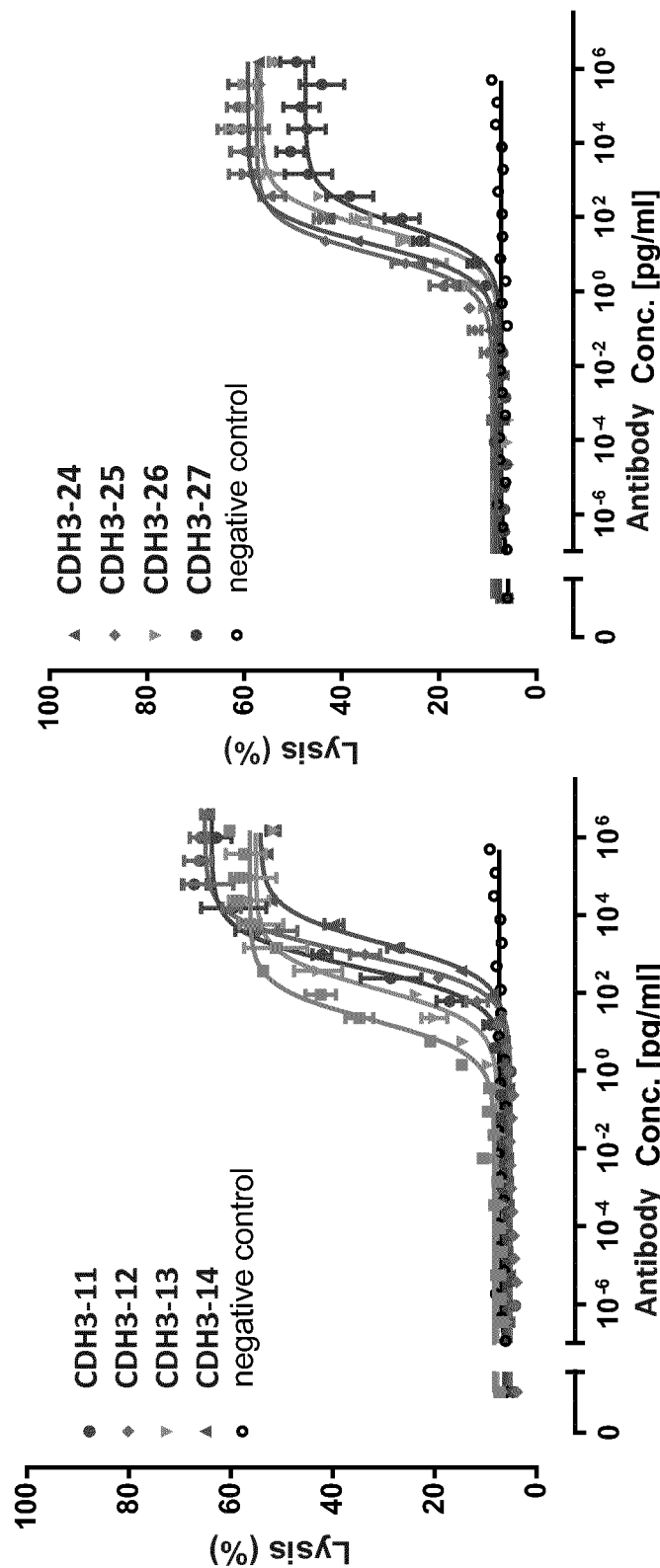

FIG. 8:

Cytotoxic activity of unstimulated human PBMC against human CDH3-transfected CHO cells in the presence of CDH3×CD3 bispecific antibodies as measured in an 48-hour FACS-based cytotoxicity assay. Effector cells: unstimulated human PBMC (CD14−/CD56−). Target cells: human CDH3 transfected CHO cells. Effector to target cell (E:T) ratio: 10:1. Antibodies specific for epitope cluster/extracellular sub-domain D2C (FIG. 8A) and D3A (FIG. 8B).

Figures 9A, 9B:
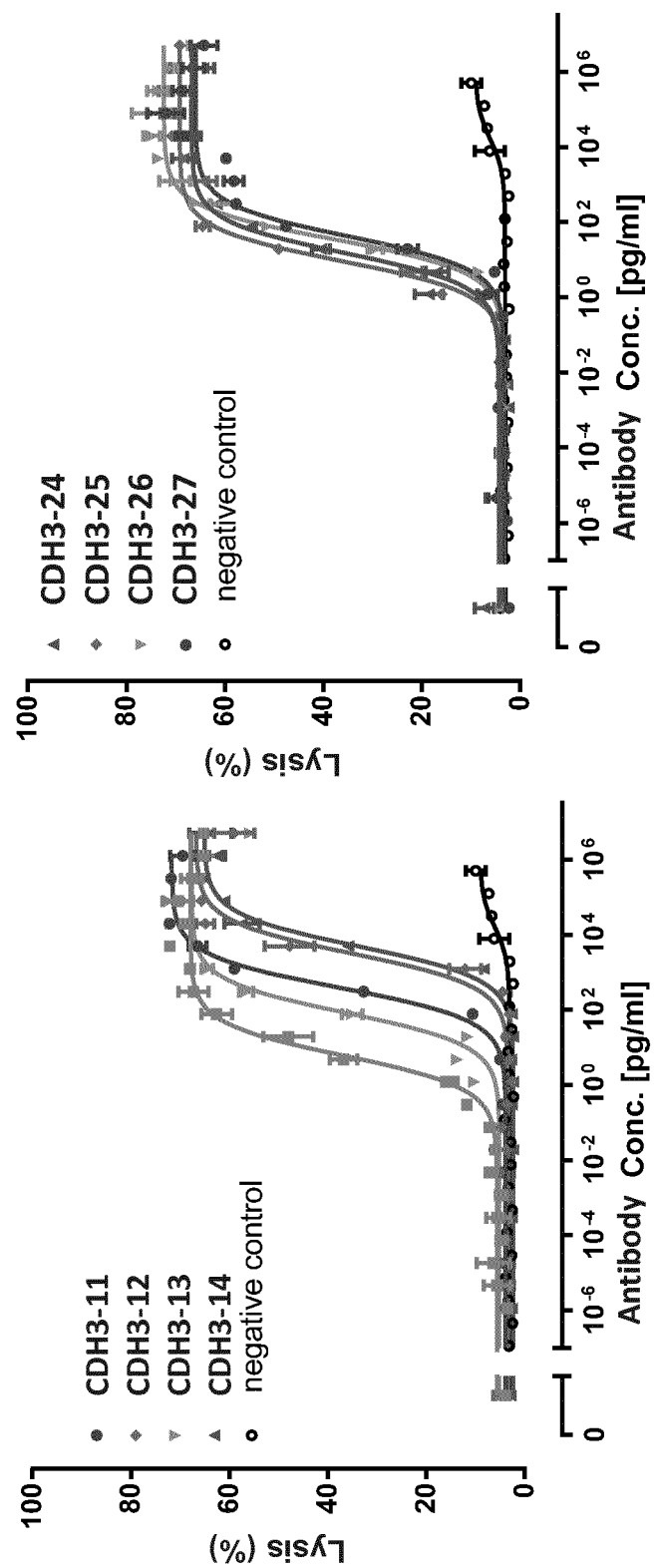

FIG. 9:

Cytotoxic activity of unstimulated human PBMC against the human CDH3 positive epidermoid carcinoma cell line A431 in the presence of CDH3×CD3 bispecific antibodies as measured in an 48-hour FACS-based cytotoxicity assay. Effector cells: unstimulated human PBMC (CD14−/CD56−). Target cells: human A431 cells. Effector to target cell (E:T) ratio: 10:1. Antibodies specific for epitope cluster/extracellular sub-domain D2C (FIG. 9A) and D3A (FIG. 9B).

Figure 10B:
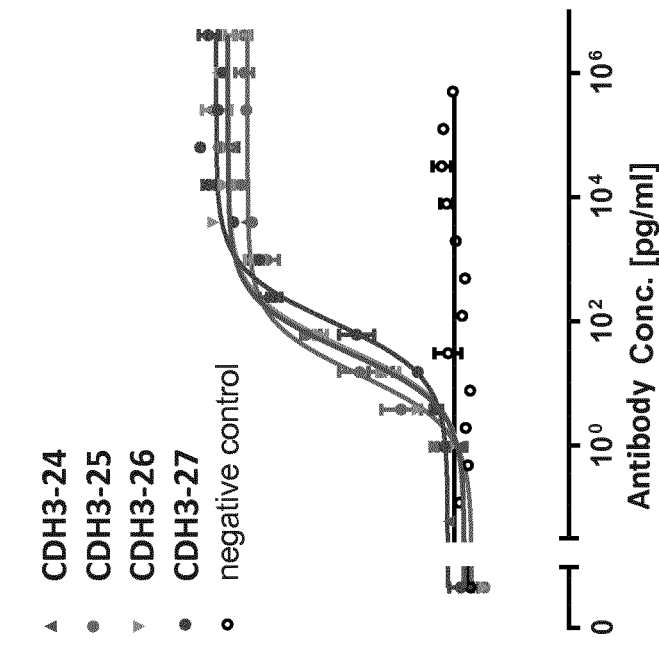
Figure 10A:
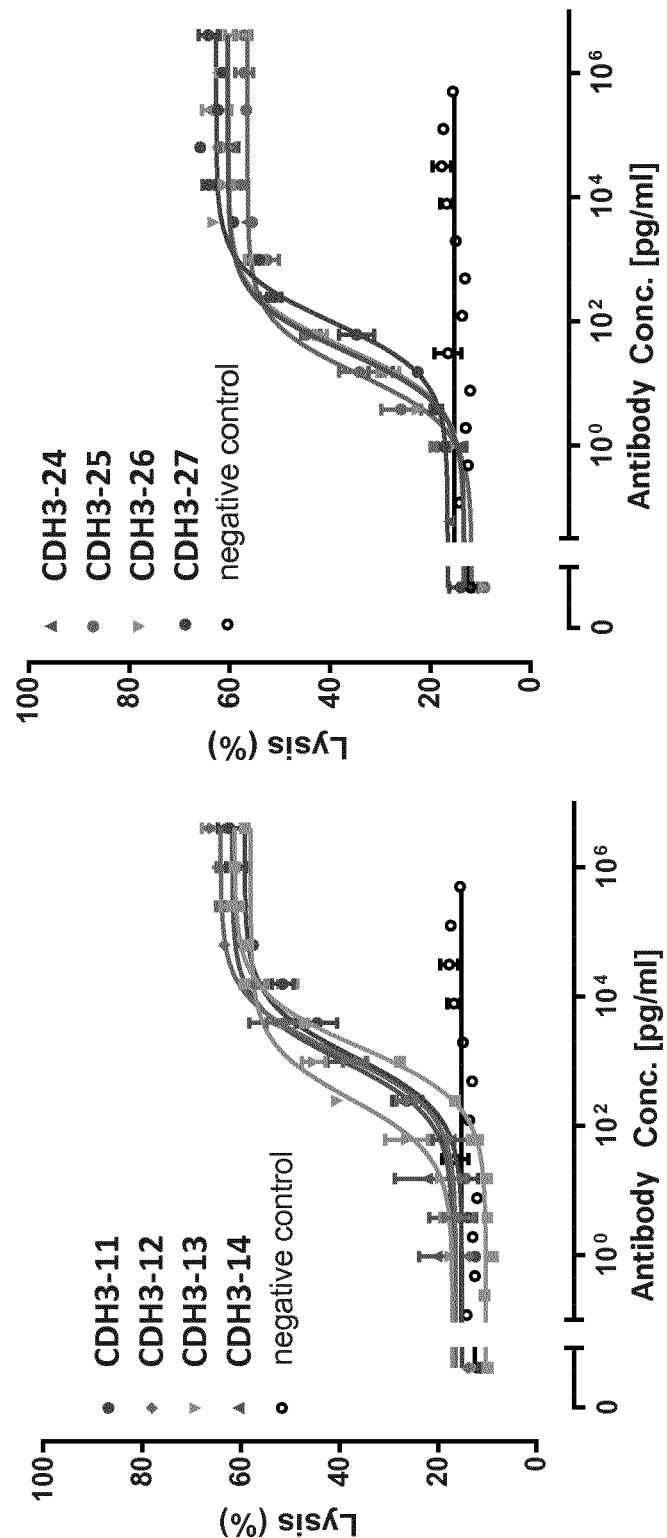
Figure 10C:
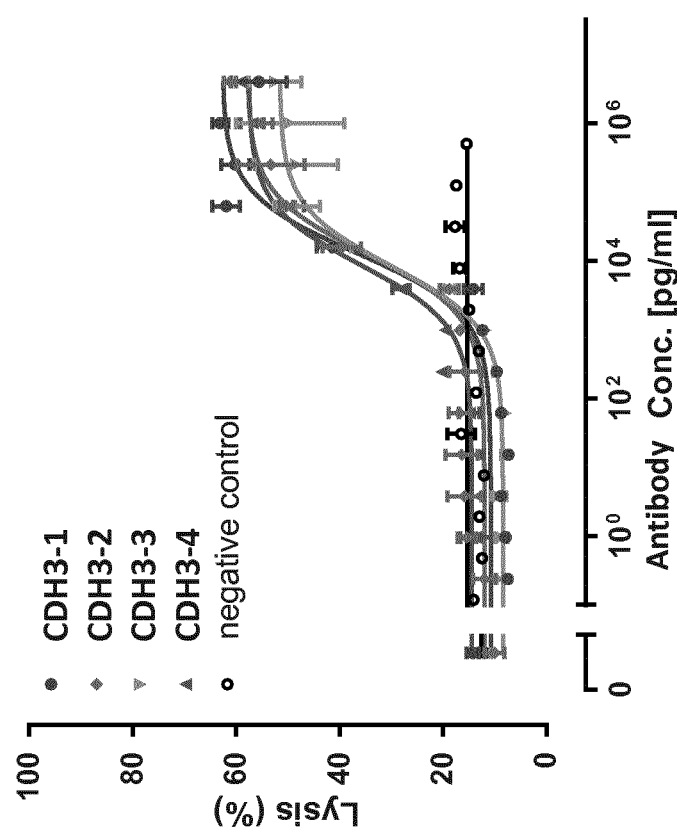

FIG. 10:

Cytotoxic activity of a macaque T cell line against macaque CDH3-transfected CHO cells in the presence of CDH3×CD3 bispecific antibodies as measured in an 48-hour FACS-based cytotoxicity assay. Effector cells: macaque CD3 positive T cell line LnPx4119. Target cells: macaque CDH3 transfected CHO cells. Effector to target cell (E:T)-ratio: 10:1. Antibodies specific for epitope cluster/extracellular sub-domain D2C (FIG. 10A), D3A (FIG. 10B) and D1B (FIG. 10C).

FIG. 11:

Anti-tumor activity of a CDH3×CD3 bispecific antibody of epitope cluster/extracellular sub-domain D2C (CDH3-13) in a human tumor xenograft model (see Example 14). The antibody dose-dependently prevents the formation of A-431 tumors in the presence of human PBMCs. High tumor volume at start of measurement (Day 5) due to large volume of cell mixture injected on Day 1. p<0.01;* p<0.0001.

Figure 12:
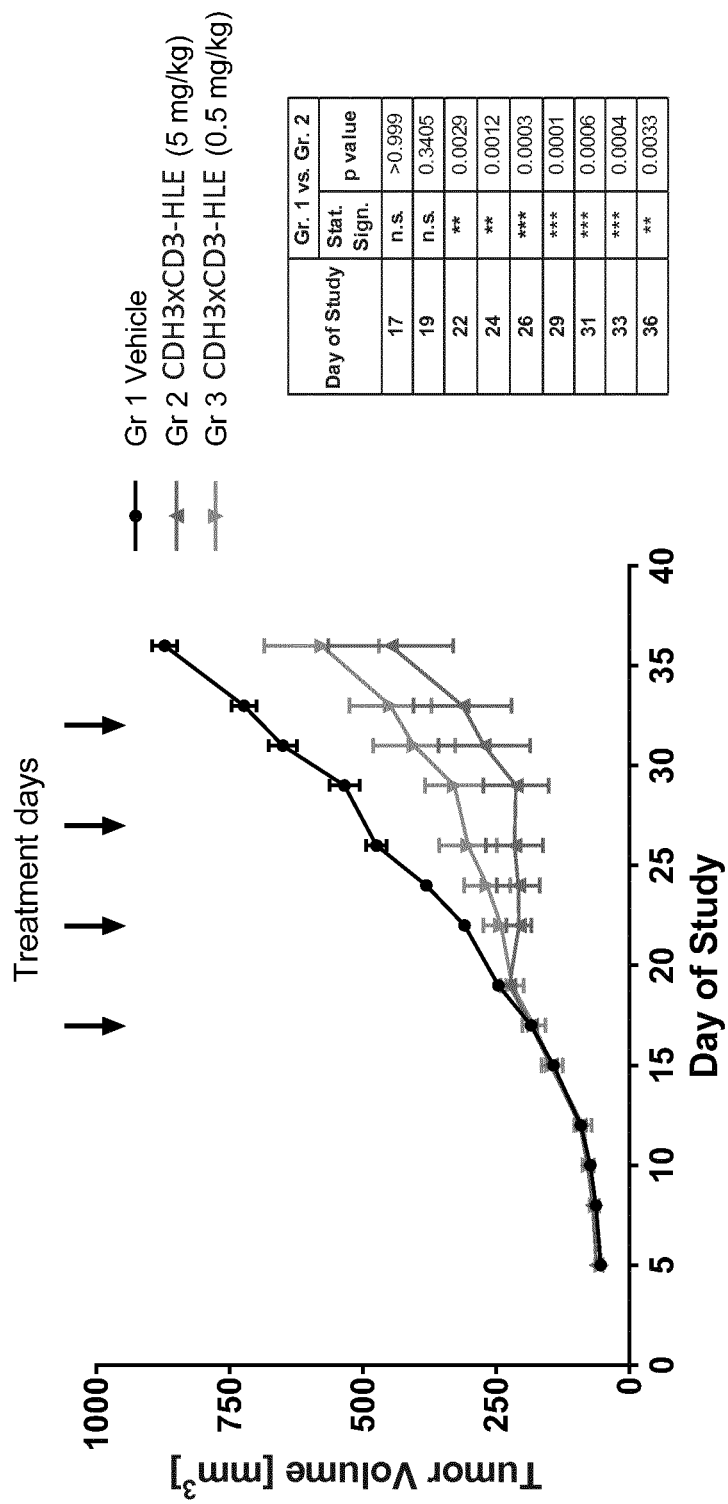
Figure 12:
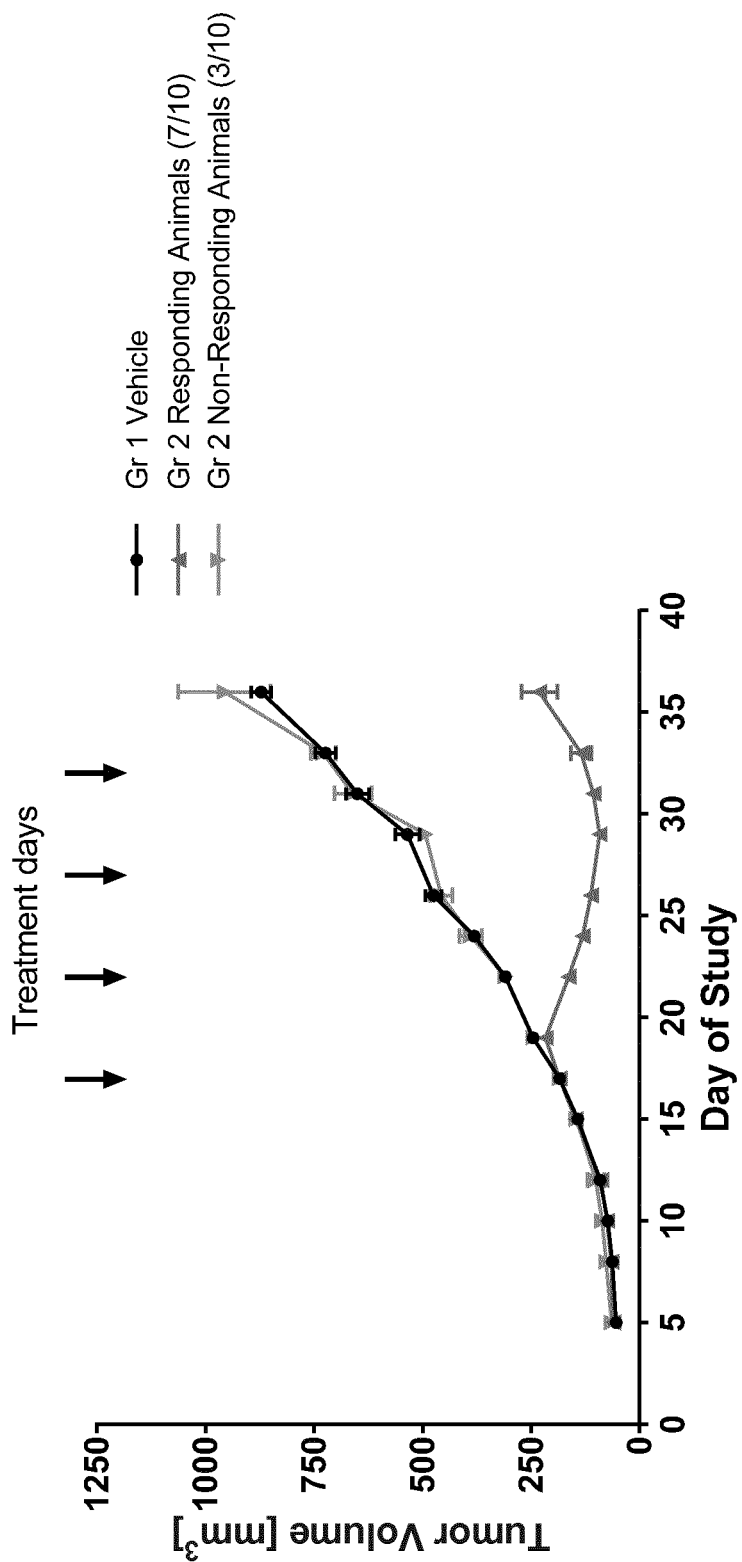

FIG. 12:

Anti-tumor activity of a CDH3×CD3 bispecific and half-life extended (HLE) antibody of epitope cluster/extracellular sub-domain D2C (CDH3-13) in a human tumor xenograft model (see Example 15). The HLE antibody dose-dependently prevents the formation of human HCT-116 tumors in the presence of human PBMCs. While FIG. 12 A shows the overall result, FIG. 12 B differentiates the result obtained for the higher antibody concentration (group 2) into responding animals (7/10) and non-responding animals (3/10).

FIG. 13:

T cell activation in the absence of target cells with bispecific antibody constructs in the absence (upper panel) and presence (lower panel) of an albumin fusion at the C-terminus of the construct.

EXAMPLES

The following examples illustrate the invention. These examples should not be construed as to limit the scope of this invention. The present invention is limited only by the claims.

Example 1

Generation of CHO Cells Expressing Wild Type and Chimeric CDH3

Figure 2:
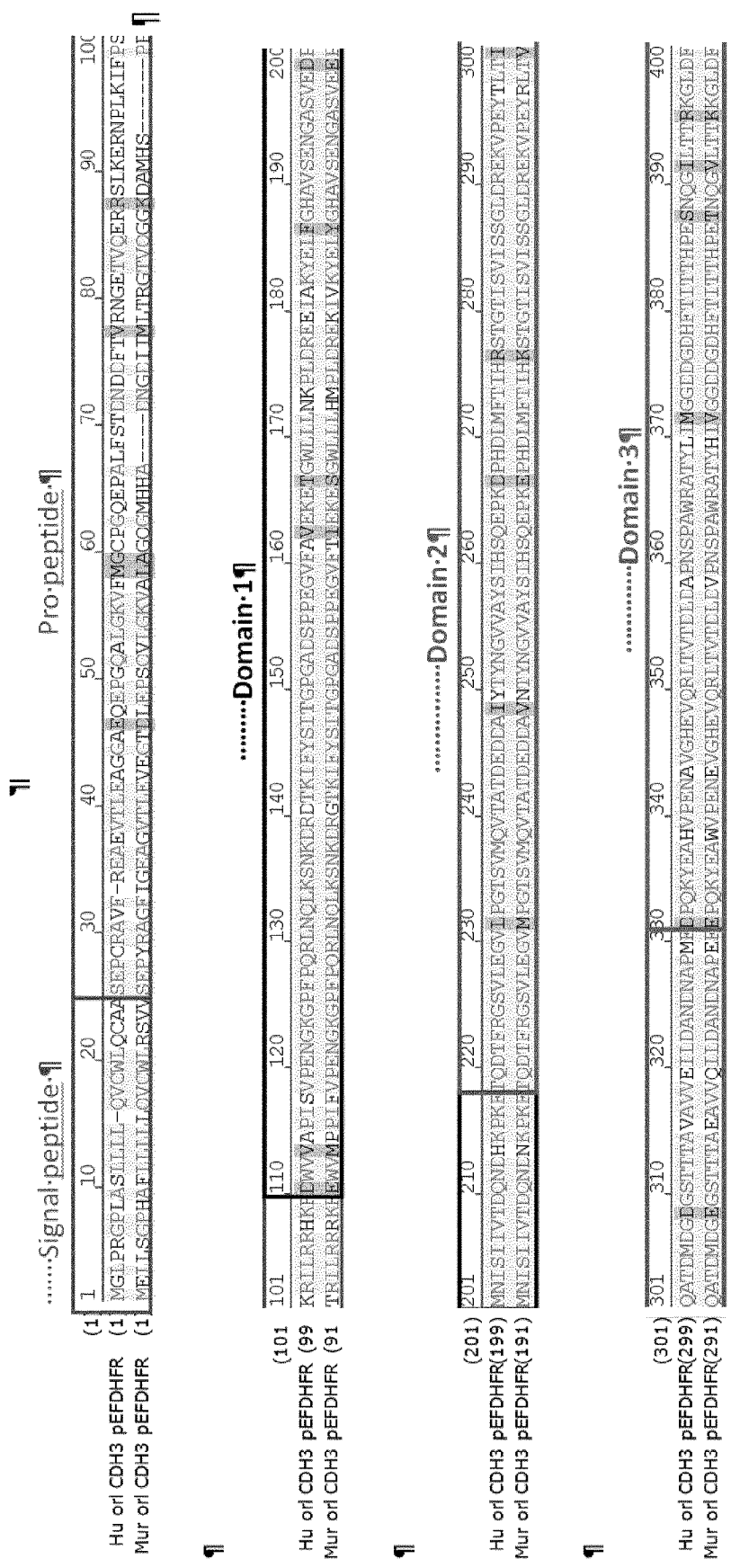
Figure 2:
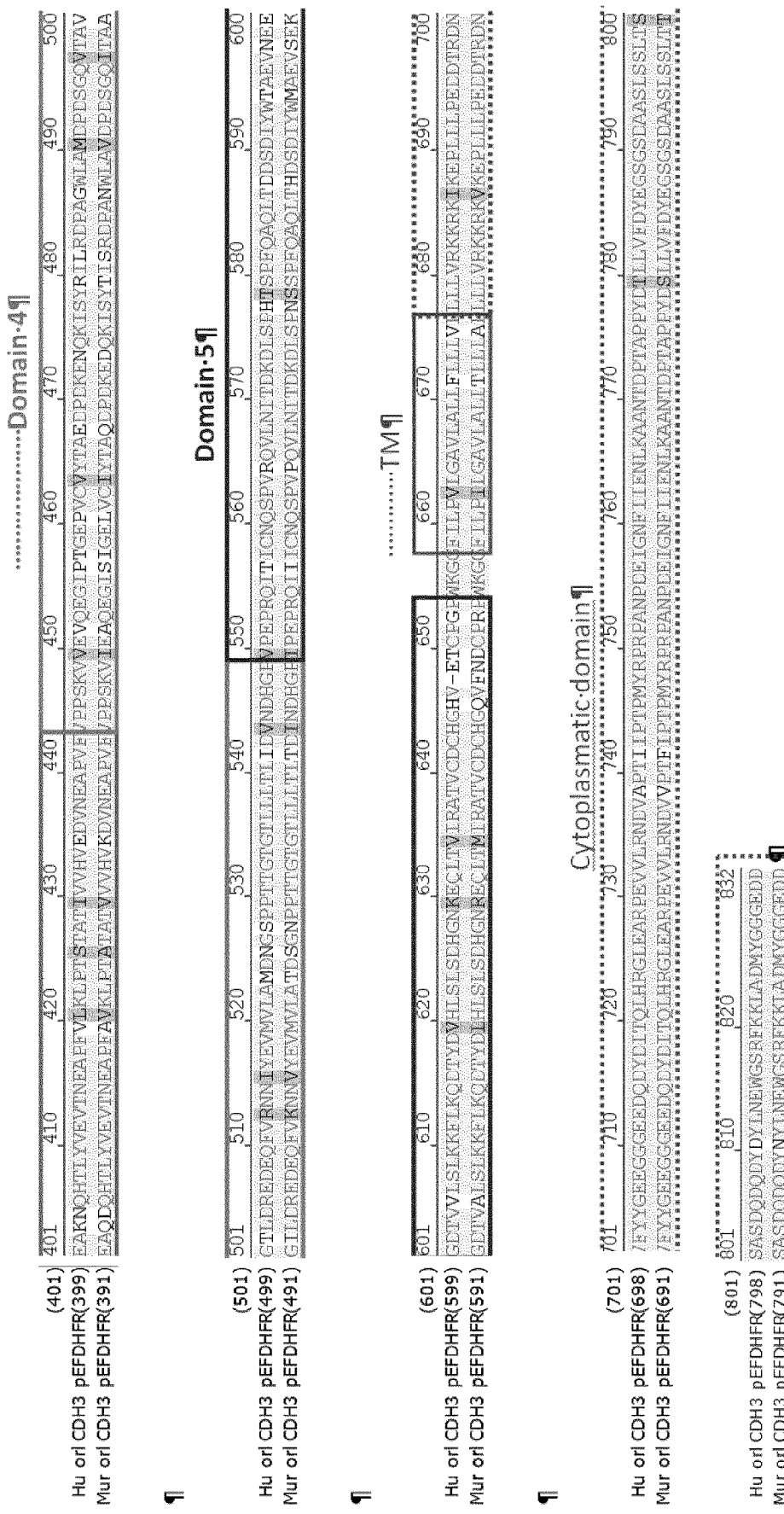

For the construction of the chimeric molecules used for epitope mapping, the sequence of the respective five extracellular domains Dom1 to Dom5 (or D1 to D5) and of their sub-domains (A, B and C) of human CDH3 was replaced by the corresponding murine sequence. The following 20 molecules were generated; see also FIGS. 1 and 2:

Hu CDH3/Dom1 mu (aa 108-215) SEQ ID NO: 13
  Hu CDH3/Dom1A mu (aa 108-143) SEQ ID NO: 14
  Hu CDH3/Dom1B mu (aa 144-179) SEQ ID NO: 15
  Hu CDH3/Dom1C mu (aa 180-215) SEQ ID NO: 16
Hu CDH3/Dom2 mu (aa 216-327) SEQ ID NO: 17
  Hu CDH3/Dom2A mu (aa 216-252) SEQ ID NO: 18
  Hu CDH3/Dom2B mu (aa 253-290) SEQ ID NO: 19
  Hu CDH3/Dom2C mu (aa 291-327) SEQ ID NO: 20
Hu CDH3/Dom3 mu (aa 328-440) SEQ ID NO: 21
  Hu CDH3/Dom3A mu (aa 328-363) SEQ ID NO: 22
  Hu CDH3/Dom3B mu (aa 364-403) SEQ ID NO: 23
  Hu CDH3/Dom3C mu (aa 404-440) SEQ ID NO: 24
Hu CDH3/Dom4 mu (aa 441-546) SEQ ID NO: 25
  Hu CDH3/Dom4A mu (aa 441-474) SEQ ID NO: 26
  Hu CDH3/Dom4B mu (aa 475-511) SEQ ID NO: 27
  Hu CDH3/Dom4C mu (aa 512-546) SEQ ID NO: 28
Hu CDH3/Dom5 mu (aa 547-650) SEQ ID NO: 29
  Hu CDH3/Dom5A mu (aa 547-581) SEQ ID NO: 30
  Hu CDH3/Dom5B mu (aa 582-616) SEQ ID NO: 31
  Hu CDH3/Dom5C mu (aa 617-650) SEQ ID NO: 32

The above listing shows the positions of the different domains (Dom1-Dom5) as well as of the respective sub-domains A-C within the amino acid sequence of human CDH3 as depicted in SEQ ID NO: 1. For example, sub-domain D1A is located in amino acid positions 108-143 of SEQ ID NO: 1. The same similarly applies for all other domains listed above.

For expression in CHO cells, the coding sequence of the above described chimeric extracellular domains was followed in frame by the coding sequence of an artificial Ser/Gly-linker followed by a domain derived from the transmembrane/intracellular domain of human EpCAM (amino acids 266-314 of the sequence as published in GenBank accession number NM 002354). All chimeric constructs comprised the N-terminal signal sequence (signal peptide) and the pro-peptide.

For the generation of CHO cells expressing human, cynomolgus macaque ("cyno"), mouse and human/mouse chimeric CDH3, the respective coding sequences of human CDH3 (SEQ ID NO: 2, see also GeneBank accession number NM_001793), cyno CDH3 (SEQ ID NO: 6), mouse CDH3 (SEQ ID NO: 10, see also GeneBank accession number NM 001037809) and of the 20 human-mouse CDH3 chimeras (see above) were cloned into a plasmid designated pEF-DHFR (pEF-DHFR is described in Raum et al. Cancer Immunol Immunother 50 (2001) 141-150). The coding sequence of macaque CDH3 was obtained by standard cloning using a cynomolgus spleen cDNA library (Bio-Chain) and human sequence specific oligonucleotides (5' GGCCCGCCGTCGCGGCAGC 3' (SEQ ID NO: 538); 5' CTCCTTCTCCAGGTTTGCTGGC 3'(SEQ ID NO: 539); 5' AACTGAGACCCCTTGGAGATGC 3'(SEQ ID NO: 540); 5' TAGTCGTCCTCCCCGCCACC 3'(SEQ ID NO: 541); 5' GGAGGGTGGGACAAACACAGG 3'(SEQ ID NO: 542); 5' ACGTTGAAGTGACCAACGAGGC 3'(SEQ ID NO: 543)) hybridizing in the untranslated region or conserved sequence regions of human CDH3 mRNA transcript (NM_001793). Sequence analysis revealed amino acid sequence similarity of the core extracellular domain compared to rhesus CDH3 GenBank sequences (JU473826, JU473827). All cloning procedures were carried out according to standard protocols (Sambrook, Molecular Cloning; A Laboratory Manual, 3rd edition, Cold Spring Harbour Laboratory Press, Cold Spring Harbour, N.Y. (2001)). For each construct, a corresponding plasmid was transfected into DHFR deficient CHO cells for eukaryotic expression, as described by Kaufman R.J. (1990) Methods Enzymol. 185, 537-566.

Figure 3:
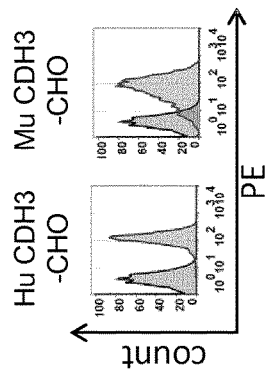
Figure 3:
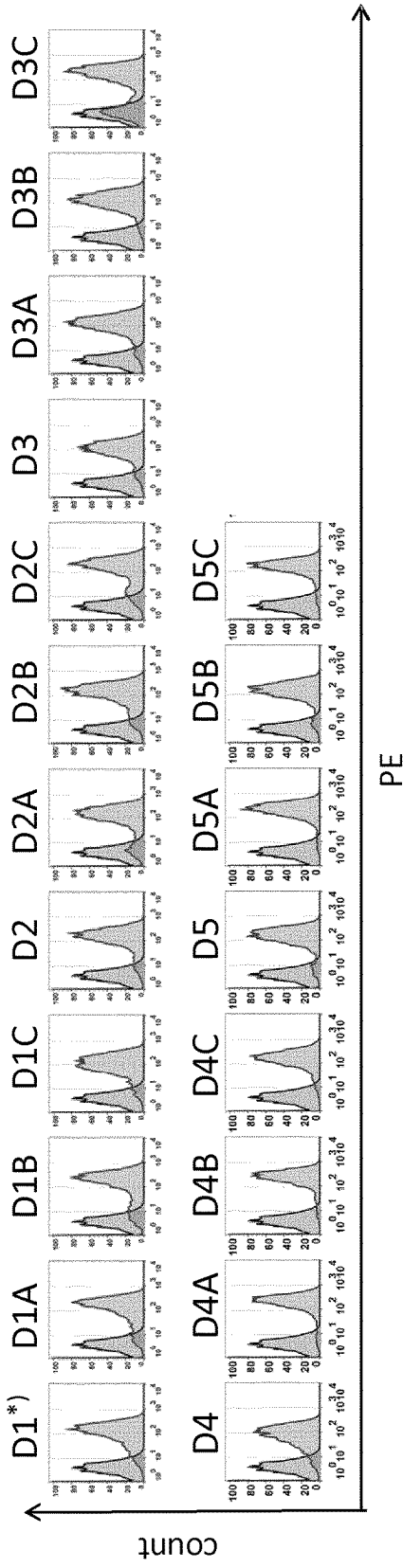

The expression of CDH3 (human, murine and the chimeric constructs) on CHO cells was verified in a FACS assay using a monoclonal mouse IgG1 anti-human CDH3 antibody which is murine cross-reactive. Bound monoclonal antibody was detected with an anti-mouse IgG Fcγ-PE. As negative control, cells were incubated with PBS/2% FCS instead of the first antibody. The samples were measured by flow cytometry. The results are shown in FIG. 3. The expression of human and cyno CDH3 on CHO cells (see Example 5) was detected with PE-conjugated R&D 861-P.

Example 2

Epitope Clustering of Murine scFv-Fragments

Cells transfected with human or murine CDH3, or with the chimeric human/mouse CDH3 molecules (see Example 1) were stained with crude, undiluted periplasmic extract containing scFv binding to human/macaque CDH3. Bound scFv molecules were detected with the mouse monoclonal anti-FLAG-M2 antibody (1 μg/ml; 50 μl in PBS/2% FCS; Sigma F1804) followed by an anti-mouse IgG Fcγ-PE (1:100, 50 μl; Jackson Immunoresearch #115-116-071) All antibodies were diluted in PBS with 2% FCS. As negative control, cells were incubated with PBS/2% FCS instead of the periplasmic extract. The samples were measured by flow cytometry. The results are shown in FIG. 4.

Specifically, FIG. 4A shows binders which recognize the extracellular domain D1 of human CDH3, and more precisely, the sub-domain D1B (loss of the FACS signal in the respective chimeric CDH3 constructs). Note that the binder denominated CDH3-6 is the parental binder for CDH3-4. The binder denominated CDH3-10 is the parental binder for CDH3-1, CDH3-2 and CDH3-3. FIG. 4B shows binders which recognize the extracellular domain D2 of human CDH3, and more precisely, the sub-domain D2C. Note that the binder denominated CDH3-21 is the parental binder for CDH3-11, CDH3-12 and CDH3-14. The binder denominated CDH3-23 is the parental binder for CDH3-13. Finally, FIG. 4C shows binders which recognize the extracellular domain D3 of human CDH3, and more precisely, the sub-domain D3A. Note that binder CDH3-32 furthermore binds to the sub-domain D3C. The binder denominated CDH3-32 is the parental binder for CDH3-25, CDH3-26 and CDH3-27. The binder denominated CDH3-33 is the parental binder for CDH3-24. The term "parental binder" means in this context that these binders were developed further in order to generate or to obtain optimized binders.

The binders CDH3-11, CDH3-12, CDH3-13 and CDH3-14 have as well been subjected to the epitope clustering analysis, and they have been shown to recognize the extracellular domain D2 of human CDH3, and more precisely, the sub-domain D2C (data not shown). The same analysis was furthermore carried out with binders CDH3-24, CDH3-25, CDH3-26 and CDH3-27. These binders recognized the extracellular domain D3 of human CDH3, and more precisely, the sub-domain D3A (data not shown).

Example 3

Biacore-Based Determination of Antibody Affinity to Human and Cynomolgus CDH3

Biacore analysis experiments were performed using recombinant CDH3 (human and cyno CDH3, respectively) fusion proteins with human albumin (HALB) to determine CDH3 target binding of the antibodies of the invention.

In detail, CM5 Sensor Chips (GE Healthcare) were immobilized with approximately 600-800 RU of the respective recombinant antigen using acetate buffer pH 4.5 according to the manufacturer's manual. The CDH3×CD3 bispecific antibody samples were loaded in five concentrations: 50 nM, 25 nM, 12.5 nM, 6.25 nM and 3.13 nM diluted in HBS-EP running buffer (GE Healthcare). Flow rate was 30 μl/min for 3 min, then HBS-EP running buffer was applied for 8 min to 20 min again at a flow rate of 30 μl/ml. Regeneration of the chip was performed using 10 mM glycine 10 mM NaCl pH 1.5 solution. Data sets were analyzed using BiaEval Software. In general two independent experiments were performed.

The CDH3×CD3 bispecific antibodies according to the invention showed high affinities to human CDH3 in the 1-digit nanomolar range. Binding to macaque CDH3 was balanced, also showing affinities in similar ranges. The affinity values as well as the calculated affinity gap are shown in Table 2. CDH3-25×F12q-HALB and CDH3-13-×I2C-HLE (Fc) were each measured in a separate assay and were shown to have a KD (hu) of 31.8±1.9 nM, a KD (cyno) of 40.9±3.89 nM and an affinity gap of 1.29, and a KD (hu) of 12.95+0.5 nM, a KD (cyno) of 12.35±0.35 nM and an affinity gap of 0.95, respectively.

TABLE 2

Affinities of CDH3xCD3 bispecific antibodies to human and macaque CDH3 as determined by Biacore analysis, as well as the calculated interspecies affinity gaps.

| CDH3×CD3 bispecific antibody | KD hu CDH3 [nM] | KD cyno CDH3 [nM] | Affinity gap cyno/hu |
|---|---|---|---|
| CDH3-11 | 7.5 | 6.2 | 0.83 |
| CDH3-12 | 8.8 | 7.5 | 0.85 |
| CDH3-13 | 7.4 | 6.0 | 0.81 |
| CDH3-14 | 9.5 | 8.1 | 0.85 |
| CDH3-24 | 6.1 | 5.2 | 0.85 |
| CDH3-25 | 7.9 | 6.7 | 0.85 |
| CDH3-26 | 8.8 | 7.5 | 0.85 |
| CDH3-27 | 8.7 | 7.6 | 0.87 |

Example 4

Scatchard-Based Analysis of CDH3×CD3 Bispecific Antibody Affinity to Human and Macaque CDH3 on Target Antigen Positive Cells and Determination of the Interspecies Affinity Gap The affinities of CDH3×CD3 bispecific antibodies to CHO cells transfected with human or macaque CDH3 were also determined by Scatchard analysis as the most reliable method for measuring potential affinity gaps between human and macaque CDH3. For Scatchard analysis, saturation binding experiments are performed using a monovalent detection system to precisely determine monovalent binding of the CDH3×CD3 bispecific antibodies to the respective cell line. 2×10⁴ cells of the respective cell line (recombinantly human CDH3-expressing CHO cell line, recombinantly macaque CDH3-expressing CHO cell line) were incubated each with 50 μl of a triplet dilution series (twelve dilutions at 1:2) of the respective CDH3×CD3 bispecific antibody (until saturation is reached) starting at 10-20 nM followed by 16 h incubation at 4° C. under agitation and one residual washing step. Then, the cells were incubated for another hour with 30 µl of a CD3×ALEXA488 conjugate solution. After one washing step, the cells were resuspended in 150 µl FACS buffer containing 3.5% formaldehyde, incubated for further 15 min, centrifuged, resuspended in FACS buffer and analyzed using a FACS CantoII machine and FACS Diva software. Data were generated from two independent sets of experiments, each using triplicates. Respective Scatchard analysis was calculated to extrapolate maximal binding (Bmax). The concentrations of CDH3×CD3 bispecific antibodies at half-maximal binding were determined reflecting the respective KDs. Values of triplicate measurements were plotted as hyperbolic curves and as S-shaped curves to demonstrate proper concentration ranges from minimal to optimal binding.

Values depicted in Table 3 were derived from two independent experiments per CDH3×CD3 bispecific antibody. Cell based Scatchard analysis confirmed that the CDH3×CD3 bispecific antibodies of the invention are nanomolar to subnanomolar in affinity to human CDH3 and present with a small cyno/human interspecies CDH3 affinity gap of around 1. CDH3-25×F12q-HALB and CDH3-13×I2C-HLE (Fc) were each measured in a separate assay and were shown to have
- a cell-based affinity (hu) of 0.37±0.11 nM, a cell-based affinity (cyno) of 0.35±0.08 nM and an affinity gap of 0.95, and
- a cell-based affinity (hu) of 0.32±0.003 nM, a cell-based affinity (cyno) of 0.5±0.09 nM and an affinity gap of 1.56, respectively.

TABLE 3

Affinities (KD) of CDH3×CD3 bispecific antibodies as determined in cell based Scatchard analysis with the calculated affinity gap KD macaque CDH3/KD human CDH3. Antibodies were measured in two independent experiments, each using triplicates.

| CDH3×CD3 bispecific antibody | Cell based affinity hu CDH-3 [nM] | Cell based affinity mac CDH-3 [nM] | Affinity gap KDmac/KDhu CDH-3 |
|---|---|---|---|
| CDH3-11 | 1.74 ± 0.37 | 1.98 ± 0.67 | 1.14 |
| CDH3-12 | 0.40 ± 0.27 | 0.52 ± 0.21 | 1.30 |
| CDH3-13 | 0.42 ± 0.35 | 0.41 ± 0.28 | 0.98 |
| CDH3-14 | 0.49 ± 0.14 | 0.41 ± 0.03 | 0.84 |
| CDH3-24 | 0.09 ± 0.03 | 0.15 ± 0.07 | 1.67 |
| CDH3-25 | 0.12 ± 0.01 | 0.11 ± 0.03 | 0.96 |
| CDH3-26 | 0.17 ± 0.01 | 0.16 ± 0.04 | 0.94 |
| CDH3-27 | 0.20 ± 0.10 | 0.23 ± 0.03 | 1.15 |

Example 5

Bispecific Binding and Interspecies Cross-Reactivity

For confirmation of binding to human CDH3 and CD3 and to cyno CDH3 and CD3, bispecific antibodies were tested by flow cytometry using
- CHO cells transfected with human and cyno CDH3, respectively,
- the human CDH3 positive epidermoid carcinoma cell line A431,
- CD3-expressing human T cell leukemia cell line HPB-all (DSMZ, Braunschweig, ACC483), and
- the cynomolgus CD3-expressing T cell line HSC-F.

Moreover, murine CDH3 transfected CHO cells were used as negative control.

For flow cytometry 200,000 cells of the respective cell lines were incubated for 30 min on ice with 50 µl of purified bispecific antibody at a concentration of 5 µg/ml. The cells were washed twice in PBS/2% FCS and binding of the constructs was detected with an in-house mouse antibody specific for the CD3 binding part. After washing, bound mouse antibodies were detected with a goat anti mouse Fcγ-PE. Samples were measured by flow cytometry.

The results are shown in FIGS. 5A and 5B. The CDH3×CD3 bispecific antibodies of the invention stained CHO cells transfected with human CDH3 and with cyno CDH3, and they also stained the human CDH3 positive epidermoid carcinoma cell line A431 (natural expresser) as well as human and cyno T cells expressing CD3. Moreover, there was no staining of the negative control cells (murine CDH3 transfected CHO).

Example 6

Confirmation of the Absence of Binding to Human and Macaque Paralogues

Human and macaque CDH3 paralogues (CDH1=E-Cadherin, CDH2=N-Cadherin, CDH4=R-Cadherin, and CDH5=VE-Cadherin) were stably transfected into dhfr$^{-/-}$ CHO cells. Protein expression was confirmed in FACS analyses with antibodies specific for the respective paralogues. Antibodies were R&D MAB18381 (for CDH1), eBioscience 12-3259-41 (for CDH2), R&D Systems polyclonal AF2217 (for CDH4) and BD Bioscience #555661 (for CDH5).

The sequences of the paralogues as used in the present Example are identified in the sequence listing (SEQ ID NOs: 41-44). They can also be found in the following GenBank, accession numbers:

NM_004360 [human CDH1]
NM_001792 [human CDH2]
NM_001794 [human CDH4]
NM_001795 [human CDH5]

The flow cytometry assay was carried out as described in Example 5. The results are shown in FIGS. 5C and 5D. The analysis confirmed that none of the CDH3×CD3 bispecific antibodies of the invention cross-reacts with any of the tested human CDH3 paralogues.

Antibodies of the invention were also verified to not cross-react with macaque CDH3 paralogues CDH1, CDH2, CDH4, and CDH5 (data not shown). Macaque paralogue expression on CHO cells was verified with the same antibodies as described above for the human paralogues. The sequences of the macaque paralogues as used in the present Example are identified in the sequence listing (SEQ ID NOs 45-48). They can also be found in the following GenBank, accession numbers:

XM_002802516 [macaque CDH1]
JU321883 [macaque CDH2]
XM_002802511 [macaque CDH5]

In addition, the macaque CDH4 sequence was obtained from Ensembl Genome Browser (ENSMMUT00000017252) and fused N-terminal in frame with the human CDH4 signal peptide (amino acids 1-19).

Example 7

Identity to Human Germline

In order to analyze the identity/similarity of the sequence of the antibodies to the human antibody germline genes, the CDH3 binders of the invention were aligned as follows: Full VL including all CDRs was aligned; full VH including CDRs 1 and 2 but except CDR3 was aligned against human antibody germline genes (Vbase). More details can be found in the specification of this application. The results are shown in Table 4 below:

TABLE 4

Identity of VH and VL to human germline

| CDH3xCD3 bispecific antibody | Identity of VH and VL to human germline [%] |
|---|---|
| CDH3-11 | 92.7 |
| CDH3-12 | 93.6 |
| CDH3-13 | 87.8 |
| CDH3-14 | 94.1 |
| CDH3-24 | 89.4 |
| CDH3-25 | 89.8 |
| CDH3-26 | 89.8 |
| CDH3-27 | 90.7 |

Example 8

Cytotoxic Activity

The potency of CDH3xCD3 bispecific antibodies of the invention in redirecting effector T cells against CDH3-expressing target cells was analyzed in five in vitro cytotoxicity assays:

The potency of CDH3xCD3 bispecific antibodies in redirecting stimulated human CD8+ effector T cells against human CDH3-transfected CHO cells was measured in an 18 hour 51-chromium release assay. Results see FIG. 6.

The potency of CDH3xCD3 bispecific antibodies in redirecting stimulated human CD8+ effector T cells against the CDH3-positive human carcinoma cell line A431 was measured in an 18 hour 51-chromium release assay. Results see FIG. 7.

The potency of CDH3xCD3 bispecific antibodies in redirecting the T cells in unstimulated human PBMC against human CDH3-transfected CHO cells was measured in a 48 hour FACS-based cytotoxicity assay. Results see FIG. 8.

The potency of CDH3xCD3 bispecific antibodies in redirecting the T cells in unstimulated human PBMC against the CDH3-positive human carcinoma cell line A431 was measured in a 48 hour FACS-based cytotoxicity assay. Results see FIG. 9.

For confirmation that the cross-reactive CDH3xCD3 bispecific antibodies are capable of redirecting macaque T cells against macaque CDH3-transfected CHO cells, a 48 hour FACS-based cytotoxicity assay was performed with a macaque T cell line as effector T cells. Results see FIG. 10.

Example 8.1

Chromium Release Assay with Stimulated Human T Cells

Stimulated T cells enriched for CD8+ T cells were obtained as described in the following. A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. 3-5×10$^7$ human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above. CD8+ cytotoxic T lymphocytes (CTLs) were enriched by depletion of CD4+ T cells and CD56+NK cells using Dynal-Beads according to the manufacturer's protocol.

Cyno CDH3- or human CDH3-transfected CHO target cells were washed twice with PBS and labeled with 11.1 MBq $^{51}$Cr in a final volume of 100 µl RPMI with 50% FCS for 60 minutes at 37° C. Subsequently, the labeled target cells were washed 3 times with κ ml RPMI and then used in the cytotoxicity assay. The assay was performed in a 96-well plate in a total volume of 200 µl supplemented RPMI with an E:T ratio of 10:1. A starting concentration of 0.01-1 µg/ml of purified bispecific antibody and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gamma counter (Perkin Elmer Life Sciences GmbH, Koln, Germany). Analysis of the results was carried out with Prism 5 for Windows (version 5.0, GraphPad Software Inc., San Diego, Calif., USA). EC50 values calculated by the analysis program from the sigmoidal dose response curves were used for comparison of cytotoxic activity.

Example 8.2

Potency of redirecting stimulated human effector T cells against human CDH3-transfected CHO Cells The cytotoxic activity of CDH3xCD3 bispecific antibodies according to the invention was analyzed in a 51-chromium ($^{51}$Cr) release cytotoxicity assay using CHO cells transfected with human CDH3 as target cells, and stimulated human CD8+ T cells as effector cells. The experiment was carried out as described in Example 8.1.

The results are shown in FIG. 6 and Table 5. The CDH3xCD3 bispecific antibodies showed potent cytotoxic activity against human CDH3 transfected CHO cells, even down to the 1-digit picomolar range. The claimed antibodies—which are specific for the epitope cluster corresponding to positions 291-363 of human CDH3—present with a favorable epitope-activity relationship supporting potent bispecific antibody mediated cytotoxic activity. CDH3-25xF12q-HALB and CDH3-13xI2C-HLE (Fc) were each measured in a separate assay and were shown to have an EC50 of 3.6 pM and 8.9 pM, respectively.

TABLE 5

EC50 values [pg/ml] of CDH3xCD3 bispecific antibodies analyzed in a 51-chromium ($^{51}$Cr) release cytotoxicity assay using CHO cells transfected with human CDH3 as target cells, and stimulated human CD8 T cells as effector cells.

| CDH3xCD3 bispecific antibody | EC50 [pg/ml] |
|---|---|
| CDH3-11 | 76 |
| CDH3-12 | 370 |
| CDH3-13 | 7.2 |
| CDH3-14 | 138 |
| CDH3-24 | 14 |
| CDH3-25 | 4.9 |
| CDH3-26 | 21 |
| CDH3-27 | 61 |

Example 8.3

Potency of Redirecting Stimulated Human Effector T Cells Against the CDH3-Positive Human Carcinoma Line A431

The cytotoxic activity of CDH3×CD3 bispecific antibodies was analyzed in a 51-chromium ($^{51}$Cr) release cytotoxicity assay using the CDH3-positive human epidermoid carcinoma cell line A431 as source of target cells, and stimulated human CD8+ T cells as effector cells. The assay was carried out as described in Example 8.1.

In accordance with the results of the 51-chromium release assays with stimulated enriched human CD8+T lymphocytes as effector cells and human CDH3-transfected CHO cells as target cells, CDH3×CD3 bispecific antibodies of the present invention are also potent in cytotoxic activity against natural expresser target cells (FIG. 7 and Table 6). CDH3-25×F12q-HALB and CDH3-13×I2C-HLE (Fc) were each measured in a separate assay and were shown to have an EC50 of 1.2 pM and 16 pM, respectively.

TABLE 6

EC50 values [pg/ml] of CDH3xCD3 bispecific antibodies analyzed in an 18-hour 51-chromium ($^{51}$Cr) release cytotoxicity assay with the CDH3-positive human carcinoma cell line A431 as source of target cells, and stimulated enriched human . CD8 T cells as effector cells

| CDH3xCD3 bispecific antibody | EC50 [pg/ml] |
|---|---|
| CDH3-11 | 47 |
| CDH3-12 | 362 |
| CDH3-13 | 62 |
| CDH3-14 | 385 |
| CDH3-24 | 5.8 |
| CDH3-25 | 4.6 |
| CDH3-26 | 19 |
| CDH3-27 | 31 |

Example 8.4

FACS-Based Cytotoxicity Assay with Unstimulated Human PBMC

Isolation of Effector Cells

Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM NH$_4$Cl, 10 mM KHCO$_3$, 100 μM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% CO$_2$ in RPMI medium (Gibco) with 10% FCS (Gibco).

Depletion of CD14$^+$ and CD56$^+$ Cells

For depletion of CD14$^+$ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 μL/10$^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 Micro-Beads (20 μL/10$^7$ cells) were added and incubated for 15 min at 4-8° C. The cells were washed with MACS isolation buffer (1-2 mL/10$^7$ cells). After centrifugation (see above), supernatant was discarded and cells resuspended in MACS isolation buffer (500 μL/10$^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.

Target Cell Labeling

For the analysis of cell lysis in flow cytometry assays, the fluorescent membrane dye DiOC$_{18}$ (DiO) (Molecular Probes, #V22886) was used to label human CDH3- or macaque CDH3-transfected CHO cells as target cells and distinguish them from effector cells. Briefly, cells were harvested, washed once with PBS and adjusted to 10$^6$ cell/mL in PBS containing 2% (v/v) FBS and the membrane dye DiO (5 μL/10$^6$ cells). After incubation for 3 min at 37° C., cells were washed twice in complete RPMI medium and the cell number adjusted to 1.25×10$^5$ cells/mL. The vitality of cells was determined using 0.5% (v/v) isotonic EosinG solution (Roth, #45380).

Flow Cytometry Based Analysis

This assay was designed to quantify the lysis of cyno or human CDH3-transfected CHO cells in the presence of serial dilutions of CDH3 bispecific antibodies. Equal volumes of DiO-labeled target cells and effector cells (i.e., PBMC w/o CD14$^+$ cells) were mixed, resulting in an E:T cell ratio of 10:1. 160 μl of this suspension were transferred to each well of a 96-well plate. 40 μL of serial dilutions of the CDH3×CD3 bispecific antibodies and a negative control bispecific (an CD3-based bispecific antibody recognizing an irrelevant target antigen) or RPMI complete medium as an additional negative control were added. The bispecific antibody-mediated cytotoxic reaction proceeded for 48 hours in a 7% CO$_2$ humidified incubator. Then cells were transferred to a new 96-well plate and loss of target cell membrane integrity was monitored by adding propidium iodide (PI) at a final concentration of 1 μg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson). Target cells were identified as DiO-positive cells. PI-negative target cells were classified as living target cells. Percentage of cytotoxicity was calculated according to the following formula:

$$\text{Cytotoxicity}[\%] = \frac{n_{dead\ target\ cells}}{n_{target\ cells}} \times 100$$

n = number of events

Using GraphPad Prism 5 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and EC50 values were calculated.

Example 8.5

Potency of Redirecting Unstimulated Human PBMC Against Human CDH3-Transfected CHO Cells The cytotoxic activity of CDH3×CD3 bispecific antibodies was analyzed in a FACS-based cytotoxicity assay using CHO cells transfected with human CDH3 as target cells, and unstimulated human PBMC as effector cells. The assay was carried out as described in Example 8.4 above.

The results of the FACS-based cytotoxicity assays with unstimulated human PBMC as effector cells and human CDH3-transfected CHO cells as targets are shown in FIG. 8 and Table 7. CDH3-25×F12q-HALB and CDH3-13×I2C-HLE (Fc) were each measured in a separate assay and were shown to have an EC50 of 4.6 pM and 5.6 pM, respectively.

TABLE 7

EC50 values [pg/ml] of CDH3×CD3 bispecific antibodies as measured in a 48-hour FACS-based cytotoxicity assay with unstimulated human PBMC as effector cells and CHO cells transfected with human CDH3 as target cells.

| CDH3×CD3 bispecific antibody | EC50 [pg/ml] |
| --- | --- |
| CDH3-11 | 462 |
| CDH3-12 | 1021 |
| CDH3-13 | 129 |
| CDH3-14 | 1885 |
| CDH3-24 | 19 |
| CDH3-25 | 10 |
| CDH3-26 | 47 |
| CDH3-27 | 61 |

Example 8.6

Potency of Redirecting Unstimulated Human PBMC Against the CDH3-Positive Human Carcinoma Line A431

The cytotoxic activity of CDH3×CD3 bispecific antibodies was furthermore analyzed in a FACS-based cytotoxicity assay using the CDH3-positive human epidermoid carcinoma cell line A431 as a source of target cells and unstimulated human PBMC as effector cells. The assay was carried out as described in Example 8.4 above. The results are shown in FIG. 9 and Table 8. CDH3-25×F12q-HALB and CDH3-13×I2C-HLE (Fc) were each measured in a separate assay and were shown to have an EC50 of 2.3 pM and 32 pM, respectively.

TABLE 8

EC50 values [pg/ml] of CDH3×CD3 bispecific antibodies oas measured in a 48-hour FACS-based cytotoxicity assay with unstimulated human PBMC as effector cells and the human A431 cell line as source of target cells.

| CDH3×CD3 bispecific antibody | EC50 [pg/ml] |
| --- | --- |
| CDH3-11 | 389 |
| CDH3-12 | 3141 |
| CDH3-13 | 83 |
| CDH3-14 | 4842 |
| CDH3-24 | 15 |
| CDH3-25 | 9.2 |
| CDH3-26 | 35 |
| CDH3-27 | 41 |

Expectedly, EC50 values were generally higher in cytotoxicity assays with unstimulated PBMC as effector cells compared with cytotoxicity assays using stimulated human CD8+ T cells.

Example 8.7

Potency of Redirecting Macaque T Cells Against Macaque CDH3-Expressing CHO Cells Finally, the cytotoxic activity of CDH3×CD3 bispecific antibodies was analyzed in a FACS-based cytotoxicity assay using CHO cells transfected with macaque (cyno) CDH3 as target cells, and a macaque T cell line as source of effector cells. The macaque T cell line 4119LnPx (Knappe et al. Blood 95:3256-61 (2000)) was used as source of effector cells. Target cell labeling of macaque CDH3-transfected CHO cells and flow cytometry based analysis of cytotoxic activity was performed as described above.

Results are shown in FIG. 10 and Table 9. Macaque T cells from cell line 4119LnPx were induced to efficiently kill macaque CDH3-transfected CHO cells by CDH3×CD3 bispecific antibodies of the invention, i.e., antibodies which bind to an epitope cluster of human CDH3 corresponding to positions 291-363 of human CDH3 and encompassing the neighboring sub-domains D2C (positions 291-327) and D3A (positions 328-363). The antibodies presented potently with 2-digit to very low 4-digit pg/ml EC50-values in this assay, confirming that these antibodies are very active in the macaque system.

Another group of anti-CDH3 antibodies had been identified during epitope clustering (see Example 2), which bind to extracellular domain D1, and more specifically, to the sub-domain D1B of human CDH3. Unexpectedly, CDH3× CD3 bispecific antibodies of this group—although potent in cytotoxic activity against CHO cells transfected with human CDH3—proved to exhibit a very weak cytotoxic activity against the macaque CDH3-transfected CHO cells (see FIG. 10C and Table 9). Antibodies of this group showed a significantly weaker potency with EC50-values in the very high 4-digit and even in the 5-digit pg/ml range. CDH3-25× F12q-HALB and CDH3-13 xI2C-HLE (Fc) were each measured in a separate assay and were shown to have an EC50 of 1.4 pM and 4.0 pM, respectively.

The CDH3×CD3 antibodies of the invention which bind to an epitope cluster of CDH3 corresponding to positions 291-363 are hence about 5 to almost 1000 times more potent in the macaque system than the antibodies which bind to the extracellular domain D1, and more specifically, to the CDH3 sub-domain D1B.

TABLE 9

EC50 values [pg/ml] of CDH3xCD3 bispecific antibodies which bind to a CDH3 epitope cluster corresponding to positions 291-363 (rows 1-8) and of CDH3xCD3 bispecific antibodies which bind to the CDH3 epitope cluster/sub-domain D1B (rows 9 to 12) as measured in a 48-hour FACS-based cytotoxicity assay with macaque T cell line 4119LnPx as effector cells and CHO cells transfected with macaque CDH3 as target cells.

|    | CDH3xCD3 bispecific antibody | EC50 [pg/ml] |
|----|------------------------------|--------------|
| 1  | CDH3-11                      | 1183         |
| 2  | CDH3-12                      | 1325         |
| 3  | CDH3-13                      | 257          |
| 4  | CDH3-14                      | 1015         |
| 5  | CDH3-24                      | 32           |
| 6  | CDH3-25                      | 14           |
| 7  | CDH3-26                      | 37           |
| 8  | CDH3-27                      | 98           |
| 9  | CDH3-1                       | 13055        |
| 10 | CDH3-2                       | 12862        |
| 11 | CDH3-3                       | 8390         |
| 12 | CDH3-4                       | 8795         |

Example 9

Monomer to Dimer Conversion after (i) Three Freeze/Thaw Cycles and (ii) 7 Days of Incubation at 250 µg/ml Bispecific CDH3xCD3 antibody monomer were subjected to different stress conditions followed by high performance SEC to determine the percentage of initially monomeric antibody, which had been converted into antibody dimer.

(i) 15 µg of monomeric antibody were adjusted to a concentration of 250 µg/ml with generic formulation buffer and then frozen at −80° C. for 30 min followed by thawing for 30 min at room temperature. After three freeze/thaw cycles the dimer content was determined by HP-SEC.

(ii) 15 µg of monomeric antibody were adjusted to a concentration of 250 µg/ml with generic formulation buffer followed by incubation at 37° C. for 7 days. The dimer content was determined by HP-SEC.

A high resolution SEC Column TSK Gel G3000 SWXL (Tosoh, Tokyo-Japan) was connected to an Äkta Purifier 10 FPLC (GE Lifesciences) equipped with an A905 Autosampler. Column equilibration and running buffer consisted of 100 mM KH2PO4-200 mM Na2SO4 adjusted to pH 6.6. The antibody solution (15 µg protein) was applied to the equilibrated column and elution was carried out at a flow rate of 0.75 ml/min at a maximum pressure of 7 MPa. The whole run was monitored at 280, 254 and 210 nm optical absorbance. Analysis was done by peak integration of the 210 nm signal recorded in the Äkta Unicorn software run evaluation sheet. Dimer content was calculated by dividing the area of the dimer peak by the total area of monomer plus dimer peak.

The results are shown in Table 10 below. The CDH3xCD3 bispecific antibodies binding to epitope cluster/extracellular sub-domain D2C presented with dimer percentages of ≤1%, and more precisely with dimer percentages of 0.0% after three freeze/thaw cycles as well as after 7 days of incubation at 37° C., which is considered very good. The dimer conversion rates of CDH3xCD3 bispecific antibodies of the epitope cluster/extracellular sub-domain D3A reached values of ≤2%, and more precisely between 0.2 and 1.8, which is considered good. CDH3-25xF12q-HALB and CDH3-13xI2C-HLE (Fc) were each measured in a separate assay and were shown to have a percentage of dimer after three freeze/thaw cycles of 1.1 and 0.84, respectively, and a percentage of dimer after 7 days of incubation of 0.0 (both HLE constructs).

TABLE 10

Percentage of monomeric versus dimeric CDH3xCD3 bispecific antibodies as determined by High Performance Size Exclusion Chromatography (HP-SEC).

| CDH3xCD3 antibody | Percentage of dimer after three freeze/thaw cycles | Percentage of dimer after 7 days of incubation |
|-------------------|---------------------------------------------------|------------------------------------------------|
| CDH3-11           | 0.00                                              | 0.00                                           |
| CDH3-12           | 0.00                                              | 0.00                                           |
| CDH3-13           | 0.00                                              | 0.00                                           |
| CDH3-14           | 0.00                                              | 0.00                                           |
| CDH3-24           | 1.01                                              | 0.20                                           |
| CDH3-25           | 1.31                                              | 0.60                                           |
| CDH3-26           | 0.82                                              | 1.80                                           |
| CDH3-27           | 1.69                                              | 1.50                                           |

Example 10

Thermostability

Antibody aggregation temperature was determined as follows: 40 µl of antibody solution at 250 µg/ml were transferred into a single use cuvette and placed in a Wyatt Dynamic Light Scattering device DynaPro Nanostar (Wyatt). The sample was heated from 40° C. to 70° C. at a heating rate of 0.5° C./min with constant acquisition of the measured radius. Increase of radius indicating melting of the protein and aggregation was used by the software package delivered with the DLS device to calculate the aggregation temperature of the antibody.

All tested CDH3xCD3 bispecific antibodies of the invention showed very favorable thermal stability with aggregation temperatures above 54° C., as shown in Table 11 below. CDH3-25xF12q-HALB was measured in a separate assay and was shown to have a thermostability of 56.3° C.

TABLE 11

Thermostability of the bispecific antibodies as determined by DLS (dynamic light scattering)

| CDH3xCD3 bispecific antibody | Thermostability (DLS ° C. aggregation) |
|------------------------------|----------------------------------------|
| CDH3-11                      | 59.8                                   |
| CDH3-12                      | 55.9                                   |
| CDH3-13                      | 59.6                                   |
| CDH3-14                      | 59.6                                   |
| CDH3-24                      | 55.1                                   |
| CDH3-25                      | 55.4                                   |
| CDH3-26                      | 54.9                                   |
| CDH3-27                      | 54.1                                   |

Example 11

Stability after Incubation for 24 Hours in Human Plasma

Purified bispecific antibodies were incubated at the ratio of 1:5 in a human plasma pool at 37° C. for 24 h-96 h at a final concentration of 2-20 µg/ml. After plasma incubation the antibodies were compared in a 51-chromium release assay with stimulated human T cells and CDH3-transfected CHO cells at a starting concentration of 0.01-0.1 µg/ml and with an effector to target cell (E:T) ratio of 10:1 (assay as described in Example 8.1 Chromium release assay with stimulated human T cells). Non-incubated, freshly thawn bispecific antibodies were includes as controls. The results are shown in Table 12. All tested antibodies had a favorable plasma stability ($EC_{50}$ plasma/$EC_{50}$ control) of ≤4, the group of antibodies binding to D3A even had a plasma stability of ≤3. CDH3-25×F12q-HALB and CDH3-13×I2C-HLE (Fc) were each measured in a separate assay and were shown to have an EC50 w/plasma of 4.4 pM, an EC50 w/o plasma of 3.6 pM, and a plasma to control ratio of 1.2, and an EC50 w/plasma of 3.4 pM, an EC50 w/o plasma of 8.9 pM, and a plasma to control ratio of 0.4, respectively.

TABLE 12

$EC_{50}$ values of the antibodies with and without plasma incubation and calculated plasma/control value

| CDH3×CD3 bispecific antibody | $EC_{50}$ [pg/mL] | | Plasma to Control ratio ($EC_{50}$ plasma/$EC_{50}$ control) |
|---|---|---|---|
| | w/Plasma | w/o Plasma | |
| CDH3-11 | 47 | 76 | 0.6 |
| CDH3-12 | 296 | 370 | 0.8 |
| CDH3-13 | 25 | 7.2 | 3.5 |
| CDH3-14 | 291 | 138 | 2.1 |
| CDH3-24 | 19 | 14 | 1.4 |
| CDH3-25 | 9.9 | 4.9 | 2.0 |
| CDH3-26 | 24 | 21 | 1.1 |
| CDH3-27 | 129 | 61 | 2.1 |

Example 12

Turbidity at 2500 µg/ml Antibody Concentration 1 ml of purified monomeric antibody solution of 250 µg/ml was concentrated by spin concentration units to 2500 µg/ml. After 16 h storage at 5° C. the turbidity of the antibody solution was determined by OD340 nm optical absorption measurement against the generic formulation buffer. The results are shown in Table 13 below. All tested antibodies have a very favourable turbidity of ≤0.05. CDH3-25×F12q-HALB and CDH3-13×I2C-HLE (Fc) were each measured in a separate assay and were shown to have a turbidity at 2500 µg/ml of 0.066 and 0.026, respectively.

TABLE 13

Turbidity of the antibody after concentration to 2.5 mg/ml over night

| CDH3×CD3 bispecific antibody | Turbidity at 2500 µg/ml |
|---|---|
| CDH3-11 | 0.035 |
| CDH3-12 | 0.025 |
| CDH3-13 | 0.030 |
| CDH3-14 | 0.025 |
| CDH3-24 | 0.019 |
| CDH3-25 | 0.026 |
| CDH3-26 | 0.028 |
| CDH3-27 | 0.022 |

Example 14

Therapeutic Efficacy of a CDH3×CD3 Bispecific Antibody in a Human Tumor Xenograft Model On day 1 of the study, cells of the human epidermoid carcinoma cell line A-431 and freshly isolated human PBMC were subcutaneously co-injected in the right dorsal flank of female NOD/SCID mice (E:T cell ratio 1:2). Mice of vehicle control group 1 (n=5) did not receive effector cells and were used as an untransplanted control for comparison with vehicle control group 2 (n=10, receiving effector cells) to monitor the impact of PBMC on tumor growth in the absence of antibody.

Mice were treated with 0.5 mg/kg/day (group 3, n=10), 0.05 mg/kg/day (group 4, n=10), or 0.005 mg/kg/day (group 5, n=10) of a CDH3×CD3 bispecific antibody specifically binding to the extracellular CDH3 sub-domain D2C by daily intravenous bolus injection for 10 consecutive days, starting approximately 2 hours after tumor cell injection on day 1.

Tumors were measured by caliper during the study and progress evaluated by intergroup comparison of tumor volumes (TV). The tumor growth inhibition T/C [%] was determined by calculating TV as T/C %=100×(median TV of analyzed group)/(median TV of control group 2).

Figure 11:
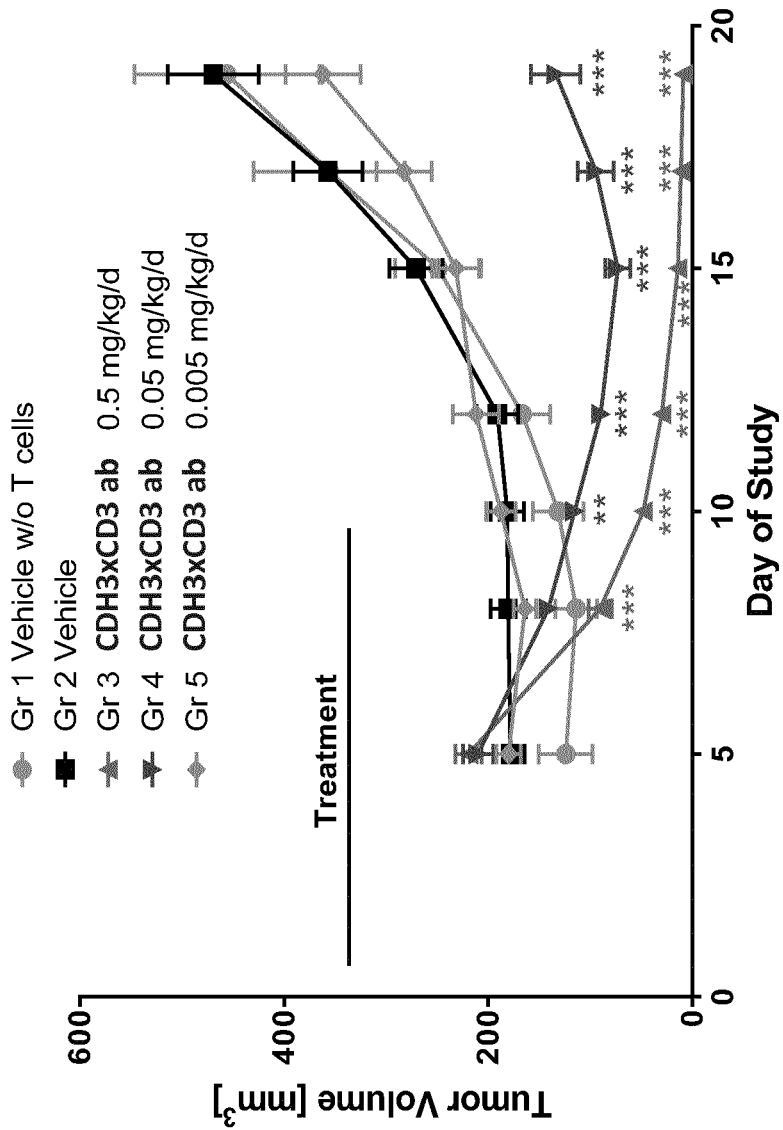

The results are shown in FIG. 11. Treatment of the mice with the CDH3×CD3 bispecific antibody at a dose level of 0.5 mg/kg/day resulted in a complete inhibition of tumor formation, and none of the animals developed a tumor until the end of the study (day 40).

Example 15

Anti-Tumor Activity of a CDH3×CD3 Bispecific HLE Antibody in an HCT-116 Tumor Model The assay was carried out in female NOD/SCID mice subcutaneously injected with human HCT-116 colon carcinoma cells. Effector cells were in vitro expanded and activated human $CD3^+$ T cells (day 12). Treatment was started when tumors had reached a volume of ~200 mm³ (day 17). The control group was a q5d vehicle-treated group with T cells. The antibody having SEQ ID NO: 425 was administered at concentrations of 5 mg/kg/admin (group 2) and 0.5 mg/kg/admin (group 3) every five days (q5d) via intravenous bolus injections. The results are shown in FIGS. 12A and 12B. In particular, FIG. 12B differentiates the result in terms of responding animals (7/10) and non-responding animals (3/10). While the reason for non-response in 30% of the animals is not clear, FIG. 12B shows that administration of the half-life extended bispecific construct at a concentration of 5 mg/kg to responding animals leads to a discontinuation of tumor growth starting from the moment of the antibody administration.

Example 16

T Cell Activation Activation Assay

Figure 13:
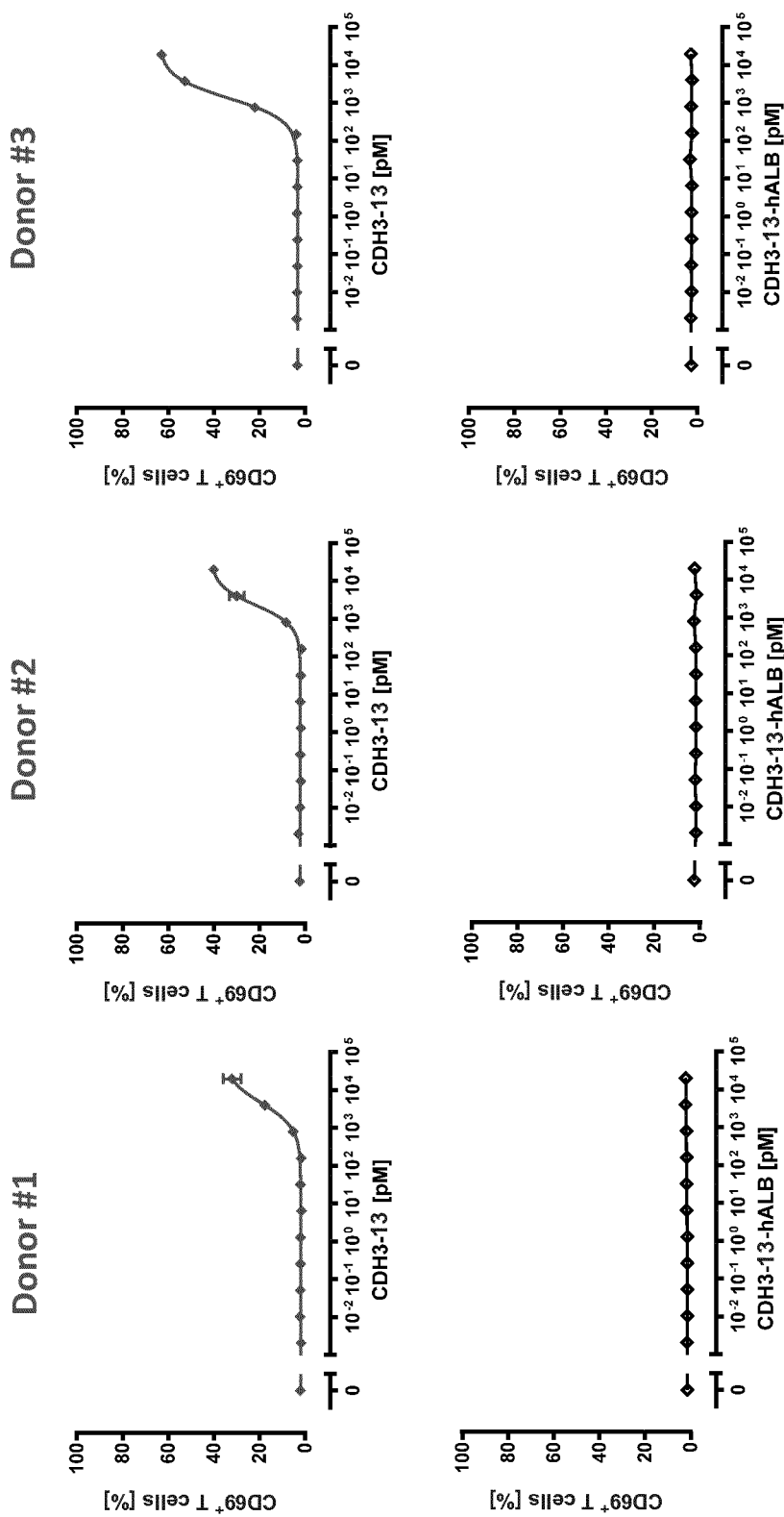

Isolated PBMC from healthy human donors were cultured with increasing concentrations of CDH3-13×I2C or CDH3-13×I2C-HALB bispecific antibody constructs for 48 h (serial dilutions of 0.001 pM-20 µM). The expression of the activation marker CD69 on CD4+ and CD8+ T cells was determined by immunostaining and flow cytometry and antigen specific conjugates mAb. The results are shown in FIG. 13 and discussed herein above.

Example 17

Cyno Pharmacokinetic Study of Half-Life Extended CDH3×CD3 Constructs

Female cynomolgus monkeys received an i.v. infusion for 60 minutes with 0.015 mg/kg of a half-life extended CDH3×CD3 bispecific antibody construct (admin. volume 1 ml/kg)

in buffer. The three HLE formats tested were P156, HALB, and HALB variant 1 (see SEQ ID NOs: 437, 443, and 444), each one fused to the C terminus of the respective construct. The half-life of these HLE constructs in the cyno model was calculated on basis of their blood plasma concentration analyzed at four (P156) and six (HALB, HALB variant 1) time points between 96 hours post-administration and termination of the study. As a result, HLE constructs with P156 showed a half-life of 57 hours, HLE constructs with HALB 63-85 hours and those with HALB variant 1 68 hours, respectively. These PK properties suggest a once weekly i.v. dosing in humans.

BAYER II SEQUENCES

| SEQ ID NO | Epitope | Designation | Format/Source | Type | Sequence |
|---|---|---|---|---|---|
| 1 | | Human CDH3 | human | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGFILPVLGAVLALLFLLLVLLLLVRKKRKIKEPLL LPEDDTRDNVFYYGEEGGGEEDQDYDITQLHRGLEARPEVVLRNDVAPTIIPTPMYR PRPANPDEIGNFIIENLKAANTDPTAPPYDTLLVFDYEGSGSDAASLSSLTSSASDQDQ DYDYLNEWGSRFKKLADMYGGGEDD |
| 2 | | Human CDH3 | human | na | ATGGGGCTCCCTCGTGGACCTCTCGCGTCTCTCCTCCTTCTCCAGGTTTGCTGGCT GCAGTGCGCGGCCTCCGAGCCGTGCCGGGCGGTCTTCAGGGAGGCTGAAGTGAC CTTGGAGGCGGGAGGCGCGGAGCAGGAGCCCGGCCAGGCGCTGGGGAAAGTATT CATGGGCTGCCCTGGGCAAGAGCCAGCTCTGTTTAGCACTGATAATGATGACTTC ACTGTGCGGAATGGCGAGACAGTCCAGGAAAGAAGGTCACTGAAGGAAAGGAA TCCATTGAAGATCTTCCCATCCAAACGTATCTTACGAAGACACAAGAGAGATTGG GTGGTTGCTCCAATATCTGTCCCTGAAAATGGCAAGGGTCCCTTCCCCAGAGAC TGAATCAGCTCAAGTCTAATAAAGATAGAGACACCAAGATTTTCTACAGCATCAC GGGGCCGGGGGCAGACAGCCCCCCTGAGGGTGTCTTCGCTGTAGAGAAGGAGAC AGGCTGGTTGTTGTTGAATAAGCCACTGGACCGGGAGGAGATTGCCAAGTATGA GCTCTTTGGCCACGCTGTGTCAGAGAATGGTGCCTCAGTGGAGGACCCCATGAAC ATCTCCATCATCGTGACCGACCAGAATGACCACAAGCCCAAGTTTACCCAGGACA CCTTCCGAGGGAGTGTCTTAGAGGGAGTCCTACCAGGTACTTCTGTGATGCAGGT GACAGCCACGGATGAGGATGATGCCATCTACACCTACAATGGGGTGGTTGCTTAC TCCATCCATAGCCAAGAACCAAAGGACCCACACGACCTCATGTTCACCATTCACC GGAGCACAGGCACCATCAGCGTCATCTCCAGTGGCCTGGACCGGGAAAAAGTCC CTGAGTACACACTGACCATCCAGGCCACAGACATGGATGGGGACGGCTCCACCA CCACGGCAGTGGCAGTAGTGGAGATCCTTGATGCCAATGACAATGCTCCCATGTT TGACCCCCAGAAGTACGAGGCCCATGTGCCTGAGAATGCAGTGGGCCATGAGGT GCAGAGGCTGACGGTCACTGATCTGGACGCCCCCAACTCACCAGCGTGGCGTGCC ACCTACCTTATCATGGGCGGTGACGACGGGGACCATTTTACCATCACCACCCACC CTGAGAGCAACCAGGGCATCCTGACAACCAGGAAGGGTTTGGATTTTGAGGCCA AAAACCAGCACACCCTGTACGTTGAAGTGACCAACGAGGCCCCTTTTGTGCTGAA GCTCCCAACCTCCACAGCCACCATAGTGGTCCACGTGGAGGATGTGAATGAGGC ACCTGTGTTTGTCCCACCCTCCAAAGTCGTTGAGGTCCAGGAGGGCATCCCCACT GGGGAGCCTGTGTGTGTCTACACTGCAGAAGACCCTGACAAGGAGAATCAAAAG ATCAGCTACCGCATCCTGAGAGACCCAGCAGGGTGGCTAGCCATGGACCCAGAC AGTGGGCAGGTCACAGCTGTGGGCACCCTCGACCGTGAGGATGAGCAGTTTGTG AGGAACAACATCTATGAAGTCATGGTCTTGGCCATGGACAATGGAAGCCCTCCCA CCACTGGCACGGGAACCTTCTGCTAACACTGATTGATGTCAATGACCATGGCCC AGTCCCTGAGCCCCGTCAGATCACCATCTGCAACCAAAGCCCTGTGCGCCAGGTG CTGAACATCACGGACAAGGACCTGTCTCCCCACACCTCCCCTTTCCAGGCCCAGC TCACAGATGACTCAGACATCTACTGGACGGCAGAGGTCAACGAGGAAGGTGACA CAGTGGTCTTGTCCCTGAAGAAGTTCCTGAAGCAGGATACATATGACGTGCACCT TTCTCTGTCTGACCATGGCAACAAAGAGCAGCTGACGGTGATCAGGGCCACTGTG TGCGACTGCCATGGCCATGTCGAAACCTGCCCTGGACCCTGGAAGGGAGGTTTCA TCCTCCCTGTGCTGGGGGCTGTCCTGGCTCTGCTGTTCCTCCTGCTGGTGCTGCTT TTGTTGGTGAGAAAGAAGCGGAAGATCAAGGAGCCCCTCCTACTCCCAGAAGAT GACACCCGTGACAACGTCTTCTACTATGGCGAAGAGGGGGGTGGCGAAGAGGAC CAGGACTATGACATCACCCAGCTCCACCGAGGTCTGGAGGCCAGGCCGGAGGTG GTTCTCCGCAATGACGTGGCACCAACCATCATCCCGACACCCATGTACCGTCCTC GGCCAGCCAACCCAGATGAAATCGGCAACTTTATAATTGAGAACCTGAAGGCGG CTAACACAGACCCCACAGCCCCGCCCTACGACACCCTCTTGGTGTTCGACTATGA GGGCAGCGGCTCCGACGCCGCGTCCCTGAGCTCCCTCACCTCCTCCGCCTCCGAC CAAGACCAAGATTACGATTATCTGAACGAGTGGGGCAGCCGCTTCAAGAAGCTG GCAGACATGTACGGTGGCGGGGAGGACGAC |
| 3 | | Human CDH3 ECD | human | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP |

BAYER II SEQUENCES

| SEQ ID NO | Epitope Designation | Format/Source | Type | Sequence |
|---|---|---|---|---|
| | | | | GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGG |
| 4 | Human CDH3 ECD | human | na | ATGGGGCTCCCTCGTGGACCTCTCGCGTCTCTCCTCCTTCTCCAGGTTTGCTGGCT GCAGTGCGCGGCCTCCGAGCCGTGCCGGGCGGTCTTCAGGGAGGCTGAAGTGAC CTTGGAGGCGGGAGGCGCGGAGCAGGAGCCCGGCCAGGCCTGGGGAAAGTATT CATGGGCTGCCCTGGGCAAGAGCCAGCTCTGTTTAGCACTGATAATGATGACTTC ACTGTGCGGAATGGCGAGACAGTCCAGGAAGAAGGTCACTGAAGGAAAGGAA TCCATTGAAGATCTTCCCATCCAAACGTATCTTACGAAGACACAAGAGAGATTGG GTGGTTGCTCCAATATCTGTCCCTGAAAATGGCAAGGGTCCCTTCCCCAGAGAC TGAATCAGCTCAAGTCTAATAAAGATAGAGACACCAAGATTTTCTACAGCATCAC GGGGCCGGGGGCAGACAGCCCCCCTGAGGGTGTCTTCGCTGTAGAGAAGGAGAC AGGCTGGTTGTTGTTGAATAAGCCACTGGACCGGGAGGAGATTGCCAAGTATGA GCTCTTTGGCCACGCTGTGTCAGAGAATGGTGCCTCAGTGGAGGACCCCATGAAC ATCTCCATCATCGTGACCGACCAGAATGACCACAAGCCCAAGTTTACCCAGGACA CCTTCCGAGGGAGTGTCTTAGAGGGAGTCCTACCAGGTACTTCTGTGATGCAGGT GACAGCCACGGATGAGGATGATGCCATCTACACCTACAATGGGGTGGTTGCTTAC TCCATCCATAGCCAAGAACCAAAGGACCCACACGACCTCATGTTCACCATTCACC GGAGCACAGGCACCATCAGCGTCATCTCCAGTGGCCTGGACCGGGAAAAAGTCC CTGAGTACACACTGACCATCCAGGCCACAGACATGGATGGGGACGGCTCCACCA CCACGGCAGTGGCAGTAGTGGAGATCCTTGATGCCAATGACAATGCTCCCATGTT TGACCCCCAGAAGTACGAGGCCCATGTGCCTGAGAATGCAGTGGGCCATGAGGT GCAGAGGCTGACGGTCACTGATCTGGACGCCCCCAACTCACCAGCGTGGCGTGCC ACCTACCTTATCATGGGCGGTGACGACGGGGACCATTTTACCATCACCACCCACC CTGAGAGCAACCAGGGCATCCTGACAACCAGGAAGGGTTTGGATTTTGAGGCCA AAAACCAGCACACCCTGTACGTTGAAGTGACCAACGAGGCCCCTTTTGTGCTGAA GCTCCCAACCTCCACAGCCACCATAGTGGTCCACGTGGAGGATGTGAATGAGGC ACCTGTGTTTGTCCCACCCTCCAAAGTCGTTGAGGTCCAGGAGGGCATCCCCACT GGGGAGCCTGTGTGTGTCTACACTGCAGAAGACCCTGACAAGGAGAATCAAAAG ATCAGCTACCGCATCCTGAGAGACCCAGCAGGGTGGCTAGCCATGGACCCAGAC AGTGGGCAGGTCACAGCTGTGGGCACCCTCGACCGTGAGGATGAGCAGTTTGTG AGGAACAACATCTATGAAGTCATGGTCTTGGCCATGGACAATGGAAGCCCTCCA CCACTGGCACGGGAACCCTTCTGCTAACACTGATTGATGTCAATGACCATGGCCC AGTCCCTGAGCCCGTCAGATCACCATCTGCAACCAAAGCCCTGTGCGCCAGGTG CTGAACATCACGGACAAGGACCTGTCTCCCCACACCTCCCCTTTCCAGGCCCAGC TCACAGATGACTCAGACATCTACTGGACGGCAGAGGTCAACGAGGAAGGTGACA CAGTGGTCTTGTCCCTGAAGAAGTTCCTGAAGCAGGATACATATGACGTGCACCT TTCTCTGTCTGACCATGGCAACAAAGAGCAGCTGACGGTGATCAGGGCCACTGTG TGCGACTGCCATGGCCATGTCGAAACCTGCCCTGGACCCTGGAAGGGAGGT |
| 5 | Macaque CDH3 | cynomolgus | aa | MGLPRGPLACLLLVQVCWLQCAASEPCRAIFGEAEVTLEAGGAEQEPSQALGKVFM GCPGQKPALFSTVNDDFTVQNGETVQDRKSLKERNPLKIFPSKRILRRHKRDWVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIHTYNGVVAYSIHSQEPKDPHDLMFTIHRSTGTISVISSGLDR EKVPEYTLTIQATDMDGDGSTTTAVAVVEILDANDNAPVFDPQKYESHVPENAVGH EVQRLTVTDLDAPNSPAWRATYLIVGGDDGDHFTIATHPESNQGILTTRKGLDFEAK NQHTLYVEVTNEAPFVLKLPTSTATIVVHVEDVNEAPVFVPPSKVVEVQEGIPTGEAV CVYTAKDPDKENQKISYRILRDPAGWLAMDPDSGQVTAGTLDREDERFVRNNIYE VMVLAVDNGSPPTTGTLLLTLIDVNDHGPVPEPREITICNQSPESQVLNITDKDLSP HTSPFQAQLTDDSDIYWMAEVNEKDDTVVLSLKKFLKQDTYDVHLSLSDHGNKEQL TVIRATVCDCHGHVEKCPDPWKGGFILPVLGAVLALLLLLVLLLLVRKKRKVKEPL LLPEDDTRDNVFYYGEEGGGEEDQDYDITQLHRGLEARPEVVLRNDVAPTFIPTPMY RPRPANPDEIGNFIIENLKAANTDPTAPPYDSLLVFDYEGSGSDAASLSSLTTSTSDQD QDYDYLNEWGSRFKKLADMYGGGDDD |
| 6 | Macaque CDH3 | cynomolgus | na | ATGGGGCTCCCTCGTGGACCTCTCGCGTGTCTCCTCCTCGTCCAGGTTTGCTGGCT GCAATGCGCGGCCTCCGAGCCGTGCCGGGCGATCTTCGGGGAGGCTGAAGTGAC CTTGGAGGCGGGAGGCGCGGAGCAGGAGCCCAGCCAGGCCCTGGGGAAAGTATT CATGGGCTGCCCTGGGCAAAAGCCAGCTCTGTTTAGCACTGTTAATGACGACTTC ACTGTGCAGAATGGCGAGACAGTCCAGGACAGAAAGTCACTGAAGGAAAGGAAT CCATTGAAGATCTTCCCATCCAAACGTATCTTACGAAGACACAAGAGAGATTGGG TGGTTGCTCCAATATCTGTCCCTGAAAATGGCAAGGGTCCCTTCCCGCAGAGGCT GAATCAGCTCAAGTCTAATAAAGACAGAGACACGAAGATTTTCTACAGCATCAC GGGGCCGGGGGCAGACAGCCCCCCTGAGGGCGTCTTTGCTGTAGAGAAAGAGAC AGGCTGGTTGTTGTTGAACAAGCCACTGGACCGGGAGGAGATTGCCAAGTATGA GCTCTTTGGCCACGCTGTGTCAGAGAATGGTGCCTCAGTGGAGGATCCCATGAAC |

-continued

| | | BAYER II SEQUENCES | | |
|---|---|---|---|---|
| SEQ ID NO | Epitope Designation | Format/ Source | Type | Sequence |
| | | | | ATCTCCATCATCGTGACCGACCAGAATGACCACAAGCCCAAGTTTACCCAGGACA<br>CCTTCCGAGGGAGTGTCTTAGAGGGAGTCCTACCAGGTACTTCTGTGATGCAGGT<br>GACGGCCACAGATGAGGATGATGCCATCCACACCTACAATGGGGTGGTTGCGTA<br>CTCCATCCATAGCCAAGAACCAAAGGATCCACACGACCTGATGTTTACCATTCAC<br>CGGAGCACAGGCACCATCAGCGTCATCTCCAGCGGCCTGGACCGGGAAAAAGTC<br>CCTGAGTACACACTGACCATCCAGGCCACAGACATGGATGGGGACGGCTCCACC<br>ACCACGGCAGTGGCAGTAGTGGAGATCCTCGATGCCAATGACAATGCTCCCGTGT<br>TTGACCCCCAGAAGTATGAGTCCCATGTGCCTGAGAATGCAGTGGGCCATGAGGT<br>GCAGAGGCTGACGGTCACTGATCTGGACGCCCCCAACTCACCAGCGTGGCGTGCC<br>ACCTACCTCATCGTGGGCGGTGACGACGGGGACCATTTTACCATCGCCACCCACC<br>CTGAGAGCAACCAGGGCATCCTGACAACCAGGAAGGGTTTGGATTTTGAGGCCA<br>AAAACCAGCACACCCTGTACGTTGAAGTGACCAACGAGGCCCCTTTTGTGCTGAA<br>GCTCCCAACCTCAACAGCCACCATAGTGGTCCACGTGGAGGATGTGAATGAGGC<br>ACCCGTGTTTGTCCCGCCCTCCAAAGTCGTTGAGGTCCAGGAGGGCATCCCCACT<br>GGGGAGGCTGTGTGTGTCTACACTGCAAAAGACCCTGACAAGGAGAATCAAAAG<br>ATCAGCTACCGCATCCTGAGAGACCCAGCAGGGTGGCTAGCCATGGACCCAGAC<br>AGTGGGCAGGTCACTGTTGCGGGCACCCTAGACCGTGAGGATGAGCGGTTTGTG<br>AGAAACAACATCTACGAAGTCATGGTCTTGGCTGTGGACAATGGAAGCCCTCCCA<br>CCACTGGCACGGGAACCCTCCTGCTAACACTGATTGATGTCAACGACCATGGCCC<br>AGTCCCTGAGCCCCGTGAGATCACCATCTGCAACCAAAGCCCTGAGTCCCAGGTG<br>CTGAACATCACGGACAAGGACCTGTCCCCCCACACCTCCCTTTCCAGGCCCAGC<br>TCACAGACGACTCAGACATCTACTGGATGGCAGAGGTCAACGAGAAAGATGACA<br>CGGTGGTCTTGTCCCTGAAGAAGTTCCTGAAGCAGGACACATATGATGTGCACCT<br>TTCTCTGTCTGACCATGGCAACAAGGAGCAGCTGACAGTGATCAGGGCCACCGTG<br>TGTGACTGCCACGGCCATGTCGAGAAATGCCCTGATCCCTGGAAGGGGGGTTTCA<br>TCCTCCCTGTGCTGGGGCTGTCCTGGCTCTGCTGCTCCTCCTGCTGGTGCTGCTC<br>TTGTTGGTGAGAAAGAAGCGGAAGGTCAAGGAGCCCCTCCTACTCCCAGAAGAT<br>GACACCCCGTGACAACGTCTTCTACTACGGCGAAGAGGGGGGTGGCGAAGAGGAC<br>CAGGACTATGACATCACCCAGCTCCACCGAGGTCTGGAGGCCAGGCCGGAGGTG<br>GTTCTCCGCAATGACGTGGCACCAACCTTCATCCCACACCCATGTACCGTCCTC<br>GGCCAGCCAACCCAGATGAAATCGGCAACTTTATAATCGAGAACCTGAAGGCAG<br>CTAACACGGACCCCACAGCCCCGCCCTACGACTCCCTTTTGGTGTTCGACTATGA<br>GGGCAGCGGCTCCGACGCCGCTCCCTGAGCTCCCTCACCACCTCCACCTCTGAC<br>CAGGACCAAGATTACGACTATCTGAACGAGTGGGGCAGCCGCTTCAAGAAGCTG<br>GCAGACATGTACGGTGGCGGGACGACGAC |
| 7 | Macaque CDH3 ECD | cynomolgus | aa | MGLPRGPLACLLLVQVCWLQCAASEPCRAIFGEAEVTLEAGGAEQEPSQALGKVFM<br>GCPGQKPALFSTVNDDFTVQNGETVQDRKSLKERNPLKIFPSKRILRRHKRDWVVAPI<br>SVPENGKGPFPQRLNQLKSNKDRDTKIFYSITGPGADSPPEGVFAVEKETGWLLLNKP<br>LDREEIAKYELFGHAVSENGASVEDPMNISIIVTDQNDHKPKFTQDTFRGSVLEGVLP<br>GTSVMQVTATDEDDAIHTYNGVVAYSIHSQEPKDPHDLMFTIHRSTGTISVISSGLDR<br>EKVPEYTLTIQATDMDGDGSTTTAVAVVEILDANDNAPVFDPQKYESHVPENAVGH<br>EVQRLTVTDLDAPNSPAWRATYLIVGGDDGDHFTIATHPESNQGILTTRKGLDFEAK<br>NQHTLYVEVTNEAPFVLKLPTSTATIVVHVEDVNEAPVFVPPSKVVEVQEGIPTGEAV<br>CVYTAKDPDKENQKISYRILRDPAGWLAMDPDSGQVTVAGTLDREDERFVRNNIYE<br>VMVLAVDNGSPPTTGTGTLLLTLIDVNDHGPVPEPREITICNQSPESQVLNITDKDLSP<br>HTSPFQAQLTDDSDIYWMAEVNEKDDTVVLSLKKFLKQDTYDVHLSLSDHGNKEQL<br>TVIRATVCDCHGHVEKCPDPWKGG |
| 8 | Macaque CDH3 ECD | cynomolgus | na | ATGGGGCTCCCTCGTGGACCTCTCGCGTGTCTCCTCCTCGTCCAGGTTTGCTGGCT<br>GCAATGCGGCCTCCGAGCCGTGCCGGGCGATCTTCGGGGAGGCTGAAGTGAC<br>CTTGGAGGCGGGAGGCGCGGAGCAGGAGCCCAGCCAGGCCCTGGGGAAAGTATT<br>CATGGGCTGCCCTGGGCAAAAGCCAGCTCTGTTTAGCACTGTTAATGACGACTTC<br>ACTGTGCAGAATGGCGAGACAGTCCAGGACAGAAAGTCACTGAAAGAAAGGAAT<br>CCATTGAAGATCTTCCCATCCAAACGTATCTTACGAAGACACAAGAGAGATTGGG<br>TGGTTGCTCCAATATCTGTCCCTGAAAATGGCAAGGGTCCCTTCCCGCAGAGGCT<br>GAATCAGCTCAAGTCTAATAAAGACAGAGACACGAAGATTTTCTACAGCATCAC<br>GGGGCCGGGGGCAGACAGCCCCCCTGAGGGCGTCTTTGCTGTAGAGAAAGAGAC<br>AGGCTGGTTGTTGTTGAACAAGCCACTGGACCGGGAGGAGATTGCCAAGTATGA<br>GCTCTTTGGCCACGCTGTGTCAGAGAATGGTGCCTCAGTGGAGGATCCCATGAAC<br>ATCTCCATCATCGTGACCGACCAGAATGACCACAAGCCCAAGTTTACCCAGGACA<br>CCTTCCGAGGGAGTGTCTTAGAGGGAGTCCTACCAGGTACTTCTGTGATGCAGGT<br>GACGGCCACAGATGAGGATGATGCCATCCACACCTACAATGGGGTGGTTGCGTA<br>CTCCATCCATAGCCAAGAACCAAAGGATCCACACGACCTGATGTTTACCATTCAC<br>CGGAGCACAGGCACCATCAGCGTCATCTCCAGCGGCCTGGACCGGGAAAAAGTC<br>CCTGAGTACACACTGACCATCCAGGCCACAGACATGGATGGGGACGGCTCCACC<br>ACCACGGCAGTGGCAGTAGTGGAGATCCTCGATGCCAATGACAATGCTCCCGTGT<br>TTGACCCCCAGAAGTATGAGTCCCATGTGCCTGAGAATGCAGTGGGCCATGAGGT<br>GCAGAGGCTGACGGTCACTGATCTGGACGCCCCCAACTCACCAGCGTGGCGTGCC<br>ACCTACCTCATCGTGGGCGGTGACGACGGGGACCATTTTACCATCGCCACCCACC<br>CTGAGAGCAACCAGGGCATCCTGACAACCAGGAAGGGTTTGGATTTTGAGGCCA<br>AAAACCAGCACACCCTGTACGTTGAAGTGACCAATGAGGCCCCTTTTGTGCTGAA<br>GCTCCCAACCTCAACAGCCACCATAGTGGTCCACGTGGAGGATGTGAATGAGGC |

-continued

| | | BAYER II SEQUENCES | | |
|---|---|---|---|---|
| SEQ ID NO | Epitope Designation | Format/ Source | Type | Sequence |
| | | | | ACCCGTGTTTGTCCCGCCCTCCAAAGTCGTTGAGGTCCAGGAGGGCATCCCCACT<br>GGGGAGGCTGTGTGTGTCTACACTGCAAAAGACCCTGACAAGGAGAATCAAAAG<br>ATCAGCTACCGCATCCTGAGAGACCCAGCAGGGTGGCTAGCCATGGACCCAGAC<br>AGTGGGCAGGTCACTGTTGCGGGCACCCTAGACCGTGAGGATGAGCGGTTTGTG<br>AGAAACAACATCTACGAAGTCATGGTCTTGGCTGTGGACAATGGAAGCCCTCCA<br>CCACTGGCACGGGAACCCTCCTGCTAACACTGATTGATGTCAACGACCATGGCCC<br>AGTCCCTGAGCCCCGTGAGATCACCATCTGCAACCAAAGCCCTGAGTCCCAGGTG<br>CTGAACATCACGGACAAGGACCTGTCCCCCCACACCTCCCCTTTCCAGGCCCAGC<br>TCACAGACGACTCAGACATCTACTGGATGGCAGAGGTCAACGAGAAAGATGACA<br>CGGTGGTCTTGTCCCTGAAGAAGTTCCTGAAGCAGGACACATATGATGTGCACCT<br>TTCTCTGTCTGACCATGGCAACAAGGAGCAGCTGACAGTGATCAGGGCCACCGTG<br>TGTGACTGCCACGGCCATGTCGAGAAATGCCCTGATCCCTGGAAGGGGGGT |
| 9 | Murine CDH3 | murine | aa | MELLSGPHAFLLLLLQVCWLRSVVSEPYRAGFIGEAGVTLEVEGTDLEPSQVLGKVA<br>LAGQGMHHADNGDIIMLTRGTVQGGKDAMHSPPTRILRRRKREWVMPPIFVPENGK<br>GPFPQRLNQLKSNKDRGTKIFYSITGPGADSPPEGVFTIEKESGWLLLHMPLDREKIVK<br>YELYGHAVSENGASVEEPMNISIIVTDQNDNKPKFTQDTFRGSVLEGVMPGTSVMQV<br>TATDEDDAVNTYNGVVAYSIHSQEPKEPHDLMFTIHKSTGTISVISSGLDREKVPEYR<br>LTVQATDMDGEGSTTTAEAVVQILDANDNAPEFEPQKYEAWVPENEVGHEVQRLTV<br>TDLDVPNSPAWRATYHIVGGDDGDHFTITTHPETNQGVLTTKKGLDFEAQDQHTLY<br>VEVTNEAPFAVKLPTATATVVVHVKDVNEAPVFVPPSKVIEAQEGISIGELVCIYTAQ<br>DPDKEDQKISYTISRDPANWLAVDPDSGQITAAGILDREDEQFVKNNVYEVMVLATD<br>SGNPPTTGTGTLLLLTLTDINDHGPIPEPRQIIICNQSPVPQVLNITDKDLSPNSSPFQAQL<br>THDSDIYWMAEVSEKGDTVALSLKKFLKQDTYDLHLSLSDHGNREQLTMIRATVCD<br>CHGQVFNDCPRPWKGGFILPILGAVLALLTLLLALLLLVRKKRKVKEPLLLPEDDTRD<br>NVFYYGEEGGGEEDQDYDITQLHRGLEARPEVVLRNDVVPTFIPTPMYRPRPANPDEI<br>GNFIIENLKAANTDPTAPPYDSLLVFDYEGSGSDAASLSSLTTSASDQDQDYNYLNEW<br>GSRFKKLADMYGGGEDD |
| 10 | Murine CDH3 | murine | na | ATGGAGCTTCTTAGTGGGCCTCACGCCTTCCTGCTCCTCCTGCTCCAGGTTTGCTG<br>GCTACGCAGCGTGGTCTCCGAGCCCTACCGAGCGGGCTTCATCGGGGAGGCTGG<br>AGTGACCTTGGAGGTGGAAGGAACTGACCTGGAGCCGAGCCAAGTTCTGGGGAA<br>AGTAGCCTTGGCTGGACAGGGCATGCACCATGCAGACAATGGAGACATCATTAT<br>GCTGACTAGGGGACAGTTCAGGGAGGGAAGGATGCGATGCACTCCCCACCCAC<br>CCGCATCTTAAGGAGACGAAAGAGAGAGTGGGTGATGCCACCAATATTCGTCCC<br>CGAGAATGGCAAGGGTCCCTTCCCTCAGAGGCTGAATCAGCTCAAATCTAATAAG<br>GACAGAGGCACCAAGATTTTCTACAGCATCACAGGGCCTGGCGCAGACAGTCCC<br>CCCGAAGGAGTCTTCACCATAGAGAAGGAGTCGGGCTGGCTGTTGTTGCATATGC<br>CACTGGACAGGGAGAAGATTGTCAAGTACGAGCTTTATGGCCACGCTGTATCTGA<br>GAATGGTGCCTCTGTAGAGGAGCCCATGAACATATCCATCATTGTGACAGACCAG<br>AATGCACAACAAGCCCAAGTTCACTCAAGACACCTTCAGAGGGAGTGGTTCTGGAG<br>GGAGTAATGCCTGGCACTTCTGTGATGCAGGTGACAGCCACAGATGAGGACGAT<br>GCTGTCAACACTTACAATGGGGTGGTGGCTTACTCCATCCATAGCCAAGAGCCGA<br>AGGAGCCACACGACCTCATGTTCACCATCCATAAAAGCACGGGAACCATTAGCG<br>TCATATCCAGTGGCCTGGACCGAGAGAAAGTCCCTGAGTACGACGACTGACCGTCCA<br>GGCCACAGACATGGATGGAGAGGGCTCTACCACGACGGCAGAGGCCGTTGTGCA<br>AATCCTTGATGCCAACGATAACGCTCCCGAGTTTGAGCCGCAGAAGTATGAGGCT<br>TGGGTGCCTGAGAACGAAGTGGGCCATGAGGTACAGAGGCTGACAGTGACTGAT<br>CTCGATGTCCCCAACTCGCCAGCGTGGCGTGCCACCTACCACATCGTGGGAGGTG<br>ATGATGGGGACCATTTCACCATCACCACTCACCCAGAGACCAACCAAGGCGTCCT<br>GACAACCAAGAAGGGTTTGGATTTTGAGGCTCAGGACCAACACACCCTGTATGTA<br>GAAGTGACCAACGAGGCTCCCTTTGCAGTGAAGCTCCCGACAGCCACTGCCACCG<br>TGGTGGTCCATGTGAAAGATGTCAACGAAGCCCCTGTGTTTGTTCCACCTTCCAA<br>GGTCATTGAGGCCCAGGAAGGCATCTCTATTGGGGAACTGGTCTGCATCTATACC<br>GCACAGGACCCAGACAAGGAGGACCAGAAGATCAGCTACACCATCTCGAGAGAT<br>CCAGCCAACTGGCTTGCTGTGGACCCAGACAGTGGTCAGATAACTGCCGCAGGC<br>ATCTTGGATCGTGAGGACGAGCAGTTTGTGAAAAACAATGTCTACGAAGTCATGG<br>TTTTGGCCACAGACAGTGGAAACCCTCCCACCACCGGCACTGGGACCCTCCTGCT<br>TACACTTACTGACATCAACGACCATGGCCCGATCCCTGAACCCAGGCAGATCATC<br>ATCTGTAACCAAAGCCCTGTGCCTCAAGTGCTGAACATCACTGACAAGGACCTGT<br>CCCCCAACTCCTCCCCTTTCCAGGCCCAGCTAACACATGACTCAGATATCTACTG<br>GATGGCAGAAGTCAGCGAGAAGGGAGACACCGTGGCCTTGTCCCTGAAGAAGTT<br>CCTGAAACAAGACACGTATGACTTGCATCTTTCTTTGTCTGACCATGGCAACAGG<br>GAACAGCTAACCATGATCAGGGCCACTGTGTGTGACTGCCATGGCCAAGTGTTCA<br>ATGACTGCCCCAGACCCTGGAAGGGTGGTTTCATCCTCCCCATCCTGGGTGCTGT<br>CCTGGCACTGCTGACCCTTCTACTGGCACTCCTCCTGTTGGTGAGGAAGAAGAGG<br>AAGGTCAAAGAGCCCCTTCTGCTCCCAGAAGATGACACGCAGACAATGTCTTCT<br>ATTATGGAGAAGAGGGTGGTGGTGAAGAGGACCAGGACTATGACATCACCCAAC<br>TCCACCGGGGACTGGAGGCCAGGCCTGAGGTGGTTCTCCGAAACGATGTAGTGC<br>CAACCTTCATCCCCACCCCCATGTACCGACCCCGGCCCGCCAACCCAGATGAAAT<br>CGGGAACTTCATCATCGAGAACCTGAAGGCTGCCAACACTGACCCTACTGCCCCG<br>CCCTACGACTCCCTGCTGGTTTTTGACTACGAGGGCAGCGGCTCTGATGCCGCCT<br>CCCTGAGCTCCCTCACCACCTCCGCCTCCGACCAGGATCAGGACTACAACTACCT |

| SEQ ID NO | Epitope Designation | Format/ Source | Type | Sequence |
|---|---|---|---|---|
| | | | | TAACGAGTGGGGAAGTCGATTCAAGAAACTGGCGGACATGTATGGTGGCGGTGA GGATGACTAG |
| 11 | Murine CDH3 ECD | murine | aa | EWVMPPIFVPENGKGPFPQRLNQLKSNKDRGTKIFYSITGPGADSPPEGVFTIEKESG WLLLHMPLDREKIVKYELYGHAVSENGASVEEPMNISIIVTDQNDNKPKFTQDTFRG SVLEGVMPGTSVMQVTATDEDDAVNTYNGVVAYSIHSQEPKEPHDLMFTIHKSTGTI SVISSGLDREKVPEYRLTVQATDMDGEGSTTTAEAVVQILDANDNAPEFEPQKYEAW VPENEVGHEVQRLTVTDLDVPNSPAWRATYHIVGGDDGDHFTITTHPETNQGVLTTK KGLDFEAQDQHTLYVEVTNEAPFAVKLPTATATVVVHVKDVNEAPVFVPPSKVIEA QEGISIGELVCIYTAQDPDKEDQKISYTISRDPANWLAVDPDSGQITAAGILDREDEQF VKNNVYEVMVLATDSGNPPTTGTGTLLLLTLTDINDHGPIPEPRQIIICNQSPVPQVLNI TDKDLSPNSSPFQAQLTHDSDIYWMAEVSEKGDTVALSLKKFLKQDTYDLHLSLSDH GNREQLTMIRATVCDCHGQVFNDCPRPWKGG |
| 12 | Murine CDH3 ECD | murine | na | GAGTGGGTGATGCCACCAATATTCGTCCCCGAGAATGGCAAGGGTCCCTTCCCTC AGAGGCTGAATCAGCTCAAATCTAATAAGGACAGAGGCACCAAGATTTTCTACA GCATCACAGGGCCTGGCGCAGACAGTCCCCCCGAAGGAGTCTTCACCATAGAGA AGGAGTCGGGCTGGCTGTTGTTGCATATGCCACTGGACAGGGAGAAGATTGTCA AGTACGAGCTTTATGGCCACGCTGTATCTGAGAATGGTGCCTCTGTAGAGGAGCC CATGAACATATCCATCATTGTGACAGACCAGAATGACAACAAGCCCAAGTTCACT CAAGACACCTTCAGAGGGAGTGTTCTGGAGGGAGTAATGCCTGGCACTTCTGTGA TGCAGGTGACAGCCACAGATGAGGACGATGCTGTCAACACTTACAATGGGGTGG TGGCTTACTCCATCCATAGCCAAGAGCCGAAGGAGCCACACGACCTCATGTTCAC CATCCATAAAAGCACGGGAACCATTAGCGTCATATCCAGTGGCCTGGACCGAGA GAAAGTCCCTGAGTACAGACTGACCGTCCAGGCCACAGACATGGATGGAGAGGG CTCTACCACGACGGCAGAGGCCGTTGTGCAAATCCTTGATGCCAACGATAACGCT CCCGAGTTTGAGCCGCAGAAGTATGAGGCTTGGGTGCCTGAGAACGAAGTGGGC CATGAGGTACAGAGGCTGACAGTGACTGATCTCGATGTCCCCAACTCGCCAGCGT GGCGTGCCACCTACCACATCGTGGGAGGTGATGATGGGGACCATTTCACCATCAC CACTCACCCAGAGACCAACCAAGGCGTCCTGACAACCAAGAAGGGTTTGGATTTT GAGGCTCAGGACCAACACACCCTGTATGTAGAAGTGACCAACGAGGCTCCCTTTG CAGTGAAGCTCCCGACAGCCACTGCCACCGTGGTGGTCCATGTGAAAGATGTCAA CGAAGCCCCTGTGTTTGTTCCACCTTCCAAGGTCATTGAGGCCCAGGAAGGCATC TCTATTGGGGAACTGGTCTGCATCTATACCGCACAGGACCCAGACAAGGAGGAC CAGAAGATCAGCTACACCATCTCGAGAGATCCAGCCAACTGGCTTGCTGTGGACC CAGACAGTGGTCAGATAACTGCCGCAGGCATCTTGGATCGTGAGGACGAGCAGT TTGTGAAAAACAATGTCTACGAAGTCATGGTTTTGGCCACAGACAGTGGAAACCC TCCCACCACCGGCACTGGGACCCTCCTGCTTACACTTACTGACATCAACGACCAT GGCCCCGATCCCTGAACCCAGGCAGATCATCATCTGTAACCAAAGCCCTGTGCCTC AAGTGCTGAACATCACTGACAAGGACCTGTCCCCCAACTCCTCCCCTTTCCAGGC CCAGCTAACACATGACTCAGATATCTACTGGATGGCAGAAGTCAGCGAGAAAGG AGACACCGTGGCCTTGTCCCTGAAGAAGTTCCTGAAACAAGACACGTATGACTTG CATCTTTCTTTGTCTGACCATGGCAACAGGGAACAGCTAACCATGATCAGGGCCA CTGTGTGTGACTGCCATGGCCAAGTGTTCAATGACTGCCCCAGACCCTGGAAGGG TGGT |
| 13 | Hu CDH3 Dom1 mu (aa 108-215) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKREWVMPPI FVPENGKGPFPQRLNQLKSNKDRGTKIFYSITGPGADSPPEGVFTIEKESGWLLLHMP LDREKIVKYELYGHAVSENGASVEEPMNISIIVTDQNDNKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTLLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVIAIVAGIVVLVISRKK RMAKYEKAEIKEMGEMHRELNA |
| 14 | Hu CDH3 Dom1A mu (aa 108-143) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKREWVMPPI FVPENGKGPFPQRLNQLKSNKDRGTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTLLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVIAIVAGIVVLVISRKK RMAKYEKAEIKEMGEMHRELNA |

BAYER II SEQUENCES

| SEQ ID NO | Epitope Designation | Format/ Source | Type | Sequence |
|---|---|---|---|---|
| 15 | Hu CDH3 Dom1B mu (aa 144-179) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFTIEKESGWLLLHMP LDREKIVKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 16 | Hu CDH3 Dom1C mu (aa 180-215) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELYGHAVSENGASVEEPMNISHVTDQNDNKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 17 | Hu CDH3 Dom2 mu (aa 216-327) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVMP GTSVMQVTATDEDDAVNTYNGVVAYSIHSQEPKEPHDLMFTIHKSTGTISVISSGLDR EKVPEYRLTVQATDMDGEGSTTTAEAVVQILDANDNAPEFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 18 | Hu CDH3 Dom2A mu (aa 216-252) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVMP GTSVMQVTATDEDDAVNTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 19 | Hu CDH3 Dom2B mu (aa 253-290) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKEPHDLMFTIHKSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |

| SEQ ID NO | Epitope Designation | Format/ Source | Type | Sequence |
|---|---|---|---|---|
| 20 | Hu CDH3 Dom2C mu (aa 291-327) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYRLTVQATDMDGEGSTTTAEAVVQILDANDNAPEFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 21 | Hu CDH3 Dom3 mu (aa 328-440) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDATYTYNGVVAYSIHSQEPKDPHDLMFTIHRSTGTISVISSGLDR EKVPEYTLTIQATDMDGDGSTTTAVAVVEILDANDNAPMFEPQKYEAWVPENEVGH EVQRLTVTDLDVPNSPAWRATYHIVGGDDGDHFTITTHPETNQGVLTTKKGLDFEAQ DQHTLYVEVTNEAPFAVKLPTATATVVVHVKDVNEAPVFPPSKVVEVQEGIPTGEP VCVYTAEDPDKENQKISYRILRDPAGWLAMDPDSGQVTAVGTLDREDEQFVRNNIY EVMVLAMDNGSPPTTGTGTLLLLTLIDVNDHGPVPEPRQITICNQSPVRQVLNITDKDL SPHTSPFQAQLTDDSDIYWTAEVNEEGDTVVLSLKKFLKQDTYDVHLSLSDHGNKEQ LTVIRATVCDCHGHVETCPGPWKGGSGGGGSGAGVIAVIVVVVIAIVAGIVVLVISRK KRMAKYEKAEIKEMGEMHRELNA |
| 22 | Hu CDH3 Dom3A mu (aa 328-363) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFEPQKYEAWVPENEVGH EVQRLTVTDLDVPNSPAWRATYLIMGGDDGDHFTITTHPESNQGILTTRKGLDFEAK NQHTLYVEVTNEAPFVLKLPTSTATIVVHVEDVNEAPVFPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 23 | Hu CDH3 Dom3B mu (aa 364-403) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYHIVGGDDGDHFTITTHPETNQGVLTTKKGLDFEAQ DQHTLYVEVTNEAPFVLKLPTSTATIVVHVEDVNEAPVFPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLLTLIDVNDHGPVPEPRQITICNQSPVRQVLNITDKDLS PHTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 24 | Hu CDH3 Dom3C mu (aa 404-440) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDATYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFAVKLPTATATVVVHVKDVNEAPVFPPSKVVEVQEGIPTGEP VCVYTAEDPDKENQKISYRILRDPAGWLAMDPDSGQVTAVGTLDREDEQFVRNNIY EVMVLAMDNGSPPTTGTGTLLLLTLIDVNDHGPVPEPRQITICNQSPVRQVLNITDKDL SPHTSPFQAQLTDDSDIYWTAEVNEEGDTVVLSLKKFLKQDTYDVHLSLSDHGNKEQ LTVIRATVCDCHGHVETCPGPWKGGSGGGGSGAGVIAVIVVVVIAIVAGIVVLVISRK KRMAKYEKAEIKEMGEMHRELNA |

-continued

BAYER II SEQUENCES

| SEQ ID NO | Epitope Designation | Format/ Source | Type | Sequence |
|---|---|---|---|---|
| 25 | Hu CDH3 Dom4 mu (aa 441-546) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVIEAQEGISIGELVC IYTAQDPDKEDQKISYTISRDPANWLAVDPDSGQITAAGILDREDEQFVKNNVYEVM VLATDSGNPPTTGTGLLLLTLTDINDHGPVPEPRQITICNQSPVRQVLNITDKDLSPHT SPFQAQLTDDSDIYWTAEVNEEGDTVVLSLKKFLKQDTYDVHLSLSDHGNKEQLTVI RATVCDCHGHVETCPGPWKGGSGGGGSGAGVIAVIVVVVIAIVAGIVVLVISRKKRM AKYEKAEIKEMGEMHRELNA |
| 26 | Hu CDH3 Dom4A mu (aa 441-474) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVIEAQEGISIGELVC IYTAQDPDKEDQKISYRILRDPAGWLAMDPDSGQVTAVGTLDREDEQFVRNNIYEV MVLAMDNGSPPTTGTGTLLLLTLIDVNDHGPVPEPRQITICNQSPVRQVLNITDKDLSP HTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 27 | Hu CDH3 Dom4B mu (aa 475-511) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYTISRDPANWLAVDPDSGQITAAGILDREDEQFVKNNIYEV MVLAMDNGSPPTTGTGTLLLLTLIDVNDHGPVPEPRQITICNQSPVRQVLNITDKDLSP HTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 28 | Hu CDH3 Dom4C mu (aa 512-546) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNVYE VMVLATDSGNPPTTGTGLLLLTLTDINDHGPVPEPRQITICNQSPVRQVLNITDKDLSP HTSPFQAQLTDDSDIYWTAEVNEEGDTVVLSLKKFLKQDTYDVHLSLSDHGNKEQL TVIRATVCDCHGHVETCPGPWKGGSGGGGSGAGVIAVIVVVVIAIVAGIVVLVISRKK RMAKYEKAEIKEMGEMHRELNA |
| 29 | Hu CDH3 Dom5 mu (aa 547-650) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDGSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTGTLLLLTLIDVNDHGPIPEPRQIICNQSPVPQVLNITDKDLSP NSSPFQAQLTHDSDIYWMAEVSEKGDTVALSLKKFLKQDTYDLHLSLSDHGNREQL TMIRATVCDCHGQVFNDCPRPWKGGSGGGGSGAGVIAVIVVVVIAIVAGIVVLVISR KKRMAKYEKAEIKEMGEMHRELNA |

BAYER II SEQUENCES

| SEQ ID NO | Epitope Designation | Format/Source | Type | Sequence |
|---|---|---|---|---|
| 30 | Hu CDH3 Dom5A mu (aa 547-581) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTLLLTLIDVNDHGPIPEPRQIIICNQSPVPQVLNITDKDLSP NSSPFQAQLTDDSDIYWTAEVNEEGDTVVLSLKKFLKQDTYDVHLSLSDHGNKEQLT VIRATVCDCHGHVETCPGPWKGGSGGGGSGAGVIAVIVVVIAIVAGIVVLVISRKK RMAKYEKAEIKEMGEMHRELNA |
| 31 | Hu CDH3 Dom5B mu (aa 582-616) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTLLLTLIDVNDHGPVPEPRQITICNQSPVRQVLNITDKDLS PHTSPFQAQLTHDSDIYWMAEVSEKGDTVALSLKKFLKQDTYDVHLSLSDHGNKEQ LTVIRATVCDCHGHVETCPGPWKGGSGGGGSGAGVIAVIVVVIAIVAGIVVLVISRK KRMAKYEKAEIKEMGEMHRELNA |
| 32 | Hu CDH3 Dom5C mu (aa 617-650) | chimeric hu/mu | aa | MGLPRGPLASLLLLQVCWLQCAASEPCRAVFREAEVTLEAGGAEQEPGQALGKVFM GCPGQEPALFSTDNDDFTVRNGETVQERRSLKERNPLKIFPSKRILRRHKRDWVVAPI SVPENGKGPFPQRLNQLKSNKDRDTKIFYSITGPGADSPPEGVFAVEKETGWLLLNKP LDREEIAKYELFGHAVSENGASVEDPMNISIIVTDQNDHKPKFTQDTFRGSVLEGVLP GTSVMQVTATDEDDAIYTYNGVVAYSIHSQEPKDPHDLMFTIHRSTGTISVISSGLDR EKVPEYTLTIQATDMDGDSTTTAVAVVEILDANDNAPMFDPQKYEAHVPENAVGH EVQRLTVTDLDAPNSPAWRATYLIMGGDDGDHFTITTHPESNQGILTTRKGLDFEAK NQHTLYVEVTNEAPFVLKLPTSTATIVVHVEDVNEAPVFVPPSKVVEVQEGIPTGEPV CVYTAEDPDKENQKISYRILRDPAGWLAMDPDSGQVTAVGTLDREDEQFVRNNIYE VMVLAMDNGSPPTTGTLLLTLIDVNDHGPVPEPRQITICNQSPVRQVLNITDKDLS PHTSPFQAQLTDDSDIYWTAEVNEEGDTVVLSLKKFLKQDTYDLHLSLSDHGNREQL TMIRATVCDCHGQVFNDCPRPWKGGSGGGGSGAGVIAVIVVVIAIVAGIVVLVISR KKRMAKYEKAEIKEMGEMHRELNA |
| 33 | Human epitope cluster D1B | human | aa | SITGPGADSPPEGVFAVEKETGWLLLNKPLDREEIA |
| 34 | Human epitope cluster D2C | human | aa | VPEYTLTIQATDMDGDSTTTAVAVVEILDANDNAPM |
| 35 | Human epitope cluster D3A | human | aa | FDPQKYEAHVPENAVGHEVQRLTVTDLDAPNSPAWR |
| 36 | Human epitope clusters D2C + D3A | human | aa | VPEYTLTIQATDMDGDSTTTAVAVVEILDANDNAPMFDPQKYEAHVPENAVGHEV QRLTVTDLDAPNSPAWR |
| 37 | Macaque epitope cluster D1B | cynomolgus | aa | SITGPGADSPPEGVFAVEKETGWLLLNKPLDREEIA |
| 38 | Macaque epitope cluster D2C | cynomolgus | aa | VPEYTLTIQATDMDGDSTTTAVAVVEILDANDNAPV |

-continued

| | | BAYER II SEQUENCES | | |
|---|---|---|---|---|
| SEQ ID NO | Epitope Designation | Format/ Source | Type | Sequence |
| 39 | Macaque epitope cluster D3A | cynomolgus | aa | FDPQKYESHVPENAVGHEVQRLTVTDLDAPNSPAWR |
| 40 | Macaque epitope clusters D2C + D3A | cynomolgus | aa | VPEYTLTIQATDMDGDGSTTTAVAVVEILDANDNAPVFDPQKYESHVPENAVGHEV QRLTVTDLDAPNSPAWR |
| 41 | Human CDH1 (E-cad.) | human | aa | MGPWSRSLSALLLLLQVSSWLCQEPEPCHPGFDAESYTFTVPRRHLERGRVLGRVNF EDCTGRQRTAYFSLDTRFKVGTDGVITVKRPLRFHNPQIHFLVYAWDSTYRKFSTKV TLNTVGHHHRPPPHQASVSGIQAELLTFPNSSPGLRRQKRDWIIPPISCPENEKGPFPK NLVQIKSNKDKEGKVFYSITGQGADTPPVGVFIIERETGWLKVTEPLDRERIATYTLFS HAVSSNGNAVEDPMEILITVTDQNDNKPEFTQEVFKGSVMEGALPGTSVMEVTATD ADDDVNTYNAAIAYTILSQDPELPDKNMFTINRNTGVISVVTTGLDRESFPTYTLVVQ AADLQGEGLSTTATAVITVTDTNDNPPIFNPTTYKGQVPENEANVVITTLKVTDADAP NTPAWEAVYTILNDDGGQFVVTTNPVNNDGILKTAKGLDFEAKQQYILHVAVTNVV PFEVSLTTSTATVTVDVLDVNEAPIFVPPEKRVEVSEDFGVGQEITSYTAQEPDTFME QKITYRIWRDTANWLEINPDTGAISTRAELDREDFEHVKNSTYTALIIATDNGSPVAT GTGTLLLILSDVNDNAPIPEPRTIFFCERNPKPQVINIIDADLPPNTSPFTAELTHGASAN WTIQYNDPTQESIILKPKMALEVGDYKINLKLMDNQNKDQVTTLEVSVCDCEGAAG VCRKAQPVEAGLQIPAILGILGGILALLILILLLLFLRRRAVVKEPLLPEDDTRDNVY YDEEGGGEEDQDFDLSQLHRGLDARPEVTRNDVAPTLMSVPRYLPRPANPDEIGNF IDENLKAADTDPTAPPYDSLLVFDYEGSGSEAASLSSLNSSESDKDQDYDYLNEWGN RFKKLADMYGGGEDD |
| 42 | Human CDH2 (N-cad.) | human | aa | MCRIAGALRTLLPLLAALLQASVEASGEIALCKTGFPEDVYSAVLSKDVHEGQPLLN VKFSNCNGKRKVQYESSEPADFKVDEDGMVYAVRSFPLSSEHAKFLIYAQDKETQE KWQVAVKLSLKPTLTEESVKESAEVEEIVFPRQFSKHSGHLQRQKRDWVIPPINLPEN SRGPFPQELVRIRSDRDKNLSLRYSVTGPGADQPPTGIFIINPISGQLSVTKPLDREQIAR FHLRAHAVDINGNQVENPIDIVINVIDMNDNRPEFLHQVWNGTVPEGSKPGTYVMTV TAIDADDPNALNGMLRYRIVSQAPSTPSPNMFTINNETGDIITVAAGLDREKVQQYTL IIQATDMEGNPTYGLSNTATAVITVTDVNDNPPEFTAMTFYGEVPENRVDIIVANLTV TDKDQPHTPAWNAVYRISGGDPTGRFAIQTDPNSNDGLVTVVKPIDFETNRMFVLTV AAENQVPLAKGIQHPPQSTATVSVTVIDVNENPYFAPNPKIIRQEEGLHAGTMLTTFT AQDPDRYMQQNIRYTKLSDPANWLKIDPVNGQITTIAVLDRESPNVKNNIYNATFLA SDNGIPPMSGTGTLQTYLLDINDNAPQVLPQEAETCETPDDPNSINITALDYDIDPNAGPF AFDLPLSPVTIKRNWTITRLNGDFAQLNLKIKFLEAGIYEVPIITDSGNPPKSNISILRV KVCQCDSNGDCTDVDRIVGAGLGTGAIIAILLCIIILLILVLMFVVWMKRRDKERQAK QLLIDPEDDVRDNILKYDEEGGGEEDQDYDLSLQQPDTVEPDAIKPVGIRRMDERPI HAEPQYPVRSAAPHPGDIGDFINEGLKAADNDPTAPPYDSLLVFDYEGSGSTAGSLSS LNSSSSGGEQDYDYLNDWGPRFKKLADMYGGGDD |
| 43 | Human CDH4 (R-cad.) | human | aa | MTAGAGVLLLLLSLSGALRAHNEDLTTRETCKAGFSEDDYTALISQNILEGEKLLQV KFSSCVGTKGTQYETNSMDFKVGADGTVFATRELQVPSEQVAFTVTAWDSQTAEK WDAVVRLLVAQTSSPHSGHKPQKGKKVVALDPSPPPKDTLLPWPQHQNANGLRRR KRDWVIPPINVPENSRGPFPQQLVRIRSDKNDIPIRYSITGVGADQPPMEVFSIDSMS GRMYVTRPMDREEHASYHLRAHAVDMNGNKVENPIDLYIYVIDMNDNRPEFINQY NGSVDEGSKPGTYVMTVTANDADDSTTANGMVRYRIVTQTPQSPSQNMFTINSETG DIVTVAAGLDREKVQQYTVIVQATDMEGNLNYGLSNTATAIITVTDVNDNPPEFTAS TFAGEVPENRVETVVANLTVMDRDQPHSPNWNAVYRIISGDPSGHFSVRTDPVTNEG MVTVVKAVDYELNRAFMLTVMSNQAPLASGIQMSFQSTAGVTISIMDINEAPYFPS NHKLIRLEEGVPPGTVLTTFSAVDPDRFMQQAVRYSKLSDPASWLHINATNGQITTA AVLDRESLYTKNNVYEATFLAADNGIPPASGTGTLQIYLIDINDNAPELLPKEAQICEK PNLNAINITAADADVDPNIGPYVFELPFVPAAVRKNWTITRLNGDYAQLSLRILYLEA GMYDVPIIVTDSGNPPLSNTSIIKVKVCPCDDNGDCTTIGAVAAAGLGTGAIVAILICIL ILLTMVLLFVMWMKRREKERHTKQLLIDPEDDVRDNILKYDEEGGGEEDQDYDLSQ LQQPEAMGHVPSKAPGVRRVDERPVGAEPQYPIRPMVPHPGDIGDFINEGLRAADND PTAPPYDSLLVFDYEGSGSTAGSVSSLNSSSSGDQDYDYLNDWGPRFKKLADMYGG GEED |
| 44 | Human CDH5 (VE-cad) | human | aa | MQRLMMLLATSGACLGLLAVAAVAAAGANPAQRDTHSLLPTHRRQKRDWIWNQM HIDEEKNTSLPHHVGKIKSSVSRKNAKYLLKGEYVGKVFRVDAETGDVFAIERLDRE NISEYHLTAVIVDKDTGENLETPSSFTIKVHDVNDNWPVFTHRLFNASVPESSAVGTS VISVTAVDADDPTVGDHASVMYQILKGKEYFAIDNSGRIITITKSLDREKQARYEIVV EARDAQGLRGDSGTATVLVTLQDINDNFPFFTQTKYTFVVPEDTRVGTSVGSLFVED PDEPQNRMTKYSILRGDYQDAFTIETNPAHNEGIIKPMKPLDYEYIQQYSFIVEATDPT IDLRYMSPPAGNRAQVIINITDVDEPPIFQQPFYHFQLKENQKKPLIGTVLAMDPDAAR HSIGYSIRRTSDKGQFFRVTKKGDIYNEKELDREVYPWYNLTVEAKELDSTGTPTGKE SIVQVHIEVLDENDNAPEFAKPYQPKVCENAVHGQLVLQISAIDKDITPRNVKFKFILN TENNFTLTDNHDNTANITVKYGQFDREHTKVHFLPVVISDNGMPSRTGSTLTVAVC KCNEQGEFTFCEDMAAQVGVSIQAVVAILLCILTITVITLLIFLRRRLRKQARAHGKSV |

BAYER II SEQUENCES

| SEQ ID NO | Epitope Designation | Format/ Source | Type | Sequence |
|---|---|---|---|---|
| | | | | PEIHEQLVTYDEEGGGEMDTTSYDVSVLNSVRRGGAKPPRPALDARPSLYAQVQKPP RHAPGAHGGPGEMAAMIEVKKDEADHDGDGPPYDTLHIYGYEGSESIAESLSSLGTD SSDSDVDYDFLNDWGPRFKMLAELYGSDPREELLY |
| 45 | Macaque CDH1 | cynomolgus | aa | MGPWSRSLSALLLLLQVSSWLCQEPEPCHPGFDAESYTFTVPRRHLERGRVLGRVSF EDCTGRQRTAYFSLDTRFKVGPDGVITVKRPLQFHNPQIHFLVYAWDSTYRKFSTKV TLNTVGHHSRTPPLHASVSGVQAELLTFPNSSPGLRRWKRDWVIPPISCPENEKGPFP KNLVQIKSNKDKEGKVFYSITGQGADTPPVGVFIIERETGVVLKVTEPLDRENIATYTL FSHAVSSNGNAVEDPMEILITVTDQNDNKPVFTQEVFKGSVMEGALPGTSVMEVTAT DADDDVNTYNAAIAYSILSQDPELPDKNMFTINKNTGVISVVTTGLDRESFPMYTLV VQAADLQGEGLSTTATAVITVTDTNDNPPVFNPTTYKGQVPENQANFVITTLKVTDA DAPNTPAWEAVYTILNDNDGQFVVTTNPVTNDGILKTAKGLDFEAKQQYILHVAVT NVAPFEVSLTTSTATVTDVLDVNEAPIFVPPEKRVEVSEDFGVGQEITSYTAREPDTF MEQKITYRIWRDAANWLEINPDTGAISTRAELDREDVEHVKNSTYTALIIATDNDHHL CDFLESHFLDEEVKLIKKIAQESIILKPKIALEVGDYKINLKLMDNQKKDQVTTLEVSV CDCEGAAGICKKAPLVEAGMQIPAILGILGGILALLILILLLLLFLRRRAVVKEPLLPPE DDTRDNVYYDEEGGGEEDQDFDLSQLHRGLDARPEVTRNDVAPTLLSVPRYLPRP ANPDEIGNFIDENLKAADSDPTAPPYDSLLVFDYEGSGSEAASLSSLNSSESDKDQDY DYLNEWGNRFKKLADMYGGGEDD |
| 46 | Macaque CDH2 | cynomolgus | aa | MCRIAGALRTLLPLLAALLQASVEASGEIALCKTGFPEDVYSAVLSKDVHEGQPLLN VKFSNCNGKRKVQYESSEPADFKVDEDGMVYAVRSFPLSSEHAKFLIYAQDKETQE KWQVAVKLSLKPALTEESVKEPPEVEEIVFPRQLSKHSGHLQRQKRDWVIPPINLPEN SRGPFPQELVRIRSDRDKNLSLRYSVTGPGADQPPTGIFIINPISGQLSVTKPLDREQIAR FHLRAHAVDINGNQVENPIDIVINVIDMNDNRPEFLHQVWNGTVPEGSKPGTYVMTV TAIDADDPNALNGMLRYRILSQAPSTPSPNMFTINNETGDIITVAAGLDREKVQQYTLI IQATDMEGNPTYGLSNTATAIITVTDVNDNPPEFTAMTFYGEVPENRVDIVANLTVT DKDQPHTPAWNAVYRISGGDPTGRFAIQTDPNSNDGLVTVVKPIDFETNRMFVLTVA AENQVPLAKGIQHPPQSTATVSVTVIDVNENPYFAPNPKIIRQEEGLHAGTMLTTFTA QDPDRYMQQNIRYTKLSDPANWLKIDPVNGQITTIAVLDRESPNVKKNIYNATFLAS DNGIPPMSGTGTLQIYLLDINDNAPQVLPQEAETCETPDPNSINITALDYDIDPNAGPF AFDLPLSPVTIKRNWTITRLNGDFAQLNLKIKFLEAGIYEVPIIITDSGNPPKSNISILRV KVCQCDSNGDCTDVDRTVGAGLGTGAIIAILLCIIILLILVLMFVVWMKRRDKERQAK QLLIDPEDDVRDNILKYDEEGGGEEDQDYDLSQLQQPDTVEPDAIKPVGIRRMDERPI HAEPQYPVRSAAPHPGDIGDFINEGLKAADNDPTAPPYDSLLVFDYEGSGSTAGSLSS LNSSSSGGEQDYDYLNDWGPRFKKLADMYGGGDD |
| 47 | Macaque CDH4 | cynomolgus | aa | MTAGAGVLLLLLSLSGALRAHNEDLTTRETCKAGFSEDDYTALISQNILEGEKLLQV KFSSCVGTKGTQYETNSVDFKVGSDGTVFATRELQVPSEQVAFTVTAWDSQTAERW DAVVRLLVAQTSSLHSGHKPQKGKKIVALDSPPPKDTLLPWPRHQNADGLRRRKR DWVIPPINVPENSRGPFPQQLVRIRSDKDNDIPIRYSITGVGADQPPMEVFSIDSMSGR MYVTRPMDREEHASYHLRAHAVDMNGNKVENPIDLYIYVIDMNDNRPEFINQVYNG SVDEGSKPGEAFSFSTRLSSPNTTTAPGNGDSHHVVTRRPRGGQGLGTQTCAAGDIVS LSRGMSREAKVQQYTVIVQATDMEGNLNYGLSNTATAIITVTDVNDNPPEFTASTFA GEVPENRVETVVANLTVMDRDQPHSPNWNAVYRIISGDPSGHFSVRTDPVTNEGMV TVVKAVDYELNRAFMLTVMVSNQAPLASGIQMSFQSTAGVTISVMDINEAPYFPSNH KLIRLEEGVPPGTVLTTFSAVDPDRFMQQAVRYSKLSDPANWLHINTTNGQITTAAV LDRESLYTKNNVYEATFLAADNGIPPASGTGTLQIYLID1NDNAPELLPKEAQICEKPN LNAINITAADADVDPNIGPYVFELPFVPAAVRKNWTITRLNGDYAQLSRILYLEAGM YDVPIIVTDSGNPPLSNTSIIKVKVCPDDNGDCTTIGAVAAAGLGTGAIVAILICILILL TMVLLFVMWMKRREKERHTKQLLIDPEDDVRDNILKYDEEGGGEEDQDYDLSQLQ QPEAMGHVPSKAPGVRRVDERPVGAEPQYPVRPMVPHPGDIGDFINEGLRAADNDP TAPPYDSLLVFDYEGSGSTAGSVSSLNSSSSGDQDYDLNDWGPRFKKLADMYGGG EED |
| 48 | Macaque CDH5 | cynomolgus | aa | MQRLMMLVATSGACLGLLAAAAAAAAGANPAQRDTPSLLPTHRRQKRDWIWNQ MHIDEEKNTSLPHHVGKIKSSVSRKNAKYLLKGEFVDKVFRVDAETGDVFAIERLDR ENISEYHLTAVIVDKDTGENLETPSSFTIKVHDVNDNWPVFTHRLFNASVPESSAVGT SVISVTAVDADDPTVGDHASVMYQILKGKEYFAIDNSGRIVTITKSLDREKQARYEIV VEARDAQGLRGDSGTATVLVTLQDINDNPPFFTQTKYTFVVPEDTRVGTSVGSLFVE DPDEPQNRMTKYSILRGDYQDAFTIETNPTHNEGIIIKPMKPLDYEYIQQYSFIVEATDP TIDLRYLSPPAGNRAQVIINITDVDEPPIFQQPFYHFQLKENQKKPLIGTVLAMDPDAA RHSIGYSIRRTSDKGQFFRVTKKGDIYNEKELDREVYPWYNLTVEAKELDSTGTPTG KESIVQVHIEVLDENDNAPEFAQPYQPKVCENAAHGQLVLQISAIDKDITPRNVKFKF TLNTENNFTLTDNHDNTANITVKYGQFDREHTKVHFLPVVISDNGMPSRTGTSTLTV AVCKCNEQGEFTFCEDMAAQVGVSIQAVVAILLSILTITVIALLIFLRRRLRKQARAHG KSVPEIHEQLVTYDEEGGGEMDTTSYDVSVLNSVRRGGAKPPRPALDARPSLYAQVQ KPPRHAPGAHGGPGEMAAMIEVKKDEADHDGDGPPYDTLHIYGYEGSESIAESLSSL GTDSSDSDVDYDFLNDWGPRFKMLAELYGSDPREELLY |

BAYER II SEQUENCES

| SEQ ID NO | Epitope | Designation | Format/Source | Type | Sequence |
|---|---|---|---|---|---|
| 49 | D1B | CDH3-1 | VH CDR1 | aa | SYAMS |
| 50 | | | VH CDR2 | aa | TISSGGHYTYYPDSVKG |
| 51 | | | VH CDR3 | aa | YYYGIPFGY |
| 52 | | | VL CDR1 | aa | RASQDIGINLI |
| 53 | | | VL CDR2 | aa | DTSSLDS |
| 54 | | | VL CDR3 | aa | LQYGSSPLT |
| 55 | | | VH | aa | EVQLLESGGGLVQPGGSLRLSCAASGFTFSSYAMSWVRQAPGKGLEWVSTISSGGHYTYYPDSVKGRFTISRDNAKNTLYLQMNSLRAEDTAVYYCASYYYGIPFGYWGQGTLVTVSS |
| 56 | | | VL | aa | DIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIK |
| 57 | | | scFv | aa | EVQLLESGGGLVQPGGSLRLSCAASGFTFSSYAMSVVRQAPGKGLEWVSTISSGGHYTYYPDSVKGRFTISRDNAKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIK |
| 58 | | | bispecific molecule | aa | EVQLLESGGGLVQPGGSLRLSCAASGFTFSSYAMSWVRQAPGKGLEWVSTISSGGHYTYYPDSVKGRFTISRDNAKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 59 | D1B | CDH3-2 | VH CDR1 | aa | SYAMS |
| 60 | | | VH CDR2 | aa | TISSGGHYTYYPDSVKG |
| 61 | | | VH CDR3 | aa | YYYGIPFGY |
| 62 | | | VL CDR1 | aa | RASQDIGINLI |
| 63 | | | VL CDR2 | aa | DTSSLDS |
| 64 | | | VL CDR3 | aa | LQYGSSPLT |
| 65 | | | VH | aa | EVQLLESGGGLVKPGGSLRLSCAASGFTFSSYAMSWVRQAPGKGLEWVATISSGGHYTYYPDSVKGRFTISRDNSKNTLYLQMNSLRAEDTAVYYCASYYYGIPFGYWGQGTLVTVSS |
| 66 | | | VL | aa | DIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIK |
| 67 | | | scFv | aa | EVQLLESGGGLVKPGGSLRLSCAASGFTFSSYAMSWVRQAPGKGLEWVATISSGGHYTYYPDSVKGRFTISRDNSKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIK |

| SEQ ID NO | Epitope | Designation | Format/Source | Type | Sequence |
|---|---|---|---|---|---|
| 68 | | | bispecific molecule | aa | EVQLLESGGGLVKPGGSLRLSCAASGFTFSSYAMSWVRQAPGKGLEWVATISSGGH YTYYPDSVKGRFTISRDNSKNTLYLQMNSLRAEDTAVYYCASYYYGIPFGYWGQGT LVTVSSGGGGSGGGGSGGGGSDIQMTQSPSTLSASLGDRVTITCRASQDIGINLIWLQ QKPGKAPKRLIYDTSSLDSGVPSRFSGSGSGTEFTLTISSLQPDDFATYYCLQYGSSPL TFGGGTKVEIKSGGGGSEVQLVESGGGLVQPGGSLKLSCAASGFTFNKYAMNWVRQ APGKGLEWVARIRSKYNNYATYYADSVKDRFTISRDDSKNTAYLQMNNLKTEDTAV YYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGS LLGGKAALTLSGVQPEDEAEYYCVLWYSNRWVFGGGTKLTVL |
| 69 | D1B | CDH3-3 | VH CDR1 | aa | SYAMS |
| 70 | | | VH CDR2 | aa | TISSGGHYTYYPDSVKG |
| 71 | | | VH CDR3 | aa | YYYGIPFGY |
| 72 | | | VL CDR1 | aa | RASQDIGINLI |
| 73 | | | VL CDR2 | aa | DTSSLDS |
| 74 | | | VL CDR3 | aa | LQYGSSPLT |
| 75 | | | VH | aa | EVQLLESGGGLVKPGGSLRLSCAASGFTFSSYAMSWVRQAPGKGLEWVATISSGGH YTYYPDSVKGRFTISRDNSKNTLYLQMNSLRAEDTAVYYCASYYYGIPFGYWGQGT LVTVSS |
| 76 | | | VL | aa | DIQMTQSPSTLSASLGDRVTITCRASQDIGINLIWLQQKPGKAPKRLIYDTSSLDSGVP SRFSGSGSGTEFTLTISSLQPDDFATYYCLQYGSSPLTFGGGTKVEIK |
| 77 | | | scFv | aa | EVQLLESGGGLVKPGGSLRLSCAASGFTFSSYAMSWVRQAPGKGLEWVATISSGGH YTYYPDSVKGRFTISRDNSKNTLYLQMNSLRAEDTAVYYCASYYYGIPFGYWGQGT LVTVSSGGGGSGGGGSGGGGSDIQMTQSPSTLSASLGDRVTITCRASQDIGINLIWLQ QKPGKAPKRLIYDTSSLDSGVPSRFSGSGSGTEFTLTISSLQPDDFATYYCLQYGSSPL TFGGGTKVEIK |
| 78 | | | bispecific molecule | aa | EVQLLESGGGLVKPGGSLRLSCAASGFTFSSYAMSWVRQAPGKGLEWVATISSGGH YTYYPDSVKGRFTISRDNSKNTLYLQMNSLRAEDTAVYYCASYYYGIPFGYWGQGT LVTVSSGGGGSGGGGSGGGGSDIQMTQSPSTLSASLGDRVTITCRASQDIGINLIWLQ QKPGKAPKRLIYDTSSLDSGVPSRFSGSGSGTEFTLTISSLQPDDFATYYCLQYGSSPL TFGGGTKVEIKSGGGGSEVQLVESGGGLVQPGGSLRLSCAASGFTFNSYAMNWVRQ APGKGLEWVARIRSKYNNYATYYADSVKGRFTISRDDSKNTAYLQMNSLKTEDTAV YYCVRHGNFGNSYVSWWAYWGQGTLVTVSSGGGGSGGGGSGGGGSQTVVTQEPS LTVSPGGTVTLTCGSSTGAVTSGNYPNWVQQKPGQAPRGLIGGTKFLAPGTPARFSG SLLGGKAALTLSGVQPEDEAEYYCVLWYSNRWVFGGGTKLTVL |
| 79 | D1B | CDH3-4 | VH CDR1 | aa | SSWMN |
| 80 | | | VH CDR2 | aa | RIYPGDGETKYADSVKG |
| 81 | | | VH CDR3 | aa | QRDYGALYAMDY |
| 82 | | | VL CDR1 | aa | RVSDDIYSYLA |
| 83 | | | VL CDR2 | aa | NAKTLAE |
| 84 | | | VL CDR3 | aa | QNHYVTPFT |
| 85 | | | VH | aa | EVQLLESGGGLVQPGGSLRLSCAASGFTFSSSWMNWVRQAPGKGLEWVSRIYPGDG ETKYADSVKGRFTISRDNSKNTLYLQMNSLRAEDTAVYYCAKQRDYGALYAMDYW GQGTLVTVSS |

BAYER II SEQUENCES

| SEQ ID NO | Epitope Designation | Format/Source | Type | Sequence |
|---|---|---|---|---|
| 86 | | VL | aa | DIQLTQSPSFLSASVGDRVTITCRVSDDIYSYLAWYQQKPGKAPKLLIYNAKTLAEGV PSRFSGSGSGTEFTLTISSLQPEDFATYYCQNHYVTPFTFGQGTKLEIK |
| 87 | | scFv | aa | EVQLLESGGGLVQPGGSLRLSCAASGFTFSSSWMNVVRQAPGKGLEWVSRIYPGDG ETKYADSVKGRFTISRDNSKNTLYLQMNSLRAEDTAVYYCAKQRDYGALYAMDYW GQGTLVTVSSGGGGSGGGGSGGGGSDIQLTQSPSFLSASVGDRVTITCRVSDDIYSYL AWYQQKPGKAPKLLIYNAKTLAEGVPSRFSGSGSGTEFTLTISSLQPEDFATYYCQNH YVTPFTFGQGTKLEIK |
| 88 | | bispecific molecule | aa | EVQLLESGGGLVQPGGSLRLSCAASGFTFSSSWMNWVRQAPGKGLEWVSRIYPGDG ETKYADSVKGRFTISRDNSKNTLYLQMNSLRAEDTAVYYCAKQRDYGALYAMDYW GQGTLVTVSSGGGGSGGGGSGGGGSDIQLTQSPSFLSASVGDRVTITCRVSDDIYSYL AWYQQKPGKAPKLLIYNAKTLAEGVPSRFSGSGSGTEFTLTISSLQPEDFATYYCQNH YVTPFTFGQGTKLEIKSGGGGSEVQLVESGGGLVQPGGSLKLSCAASGFTFNKYAMN WVRQAPGKGLEWVARIRSKYNNYATYYADSVKDRFTISRDDSKNTAYLQMNNLKT EDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVL |
| 89 | D1B CDH3-5 | VH CDR1 | aa | TSWMN |
| 90 | | VH CDR2 | aa | RIYPGDGETKYNGKFKG |
| 91 | | VH CDR3 | aa | QRDYGALYALDY |
| 92 | | VL CDR1 | aa | RASENIYSYLA |
| 93 | | VL CDR2 | aa | NAKTLAE |
| 94 | | VL CDR3 | aa | QHHYVPPYT |
| 95 | | VH | aa | EVQLVEQSGAELVKPGASVKISCKASGYAFSTSWMNWVKQRPGKGLEWIGRIYPGD GETKYNGKFKGKATLTADKSSSTAYMQLSSLTSEDSAVYFCARQRDYGALYALDY WGQGTRVTVSS |
| 96 | | VL | aa | ELMMTQTPASLSASVGETVTFTCRASENIYSYLAWYQQKQGKSPQLLVYNAKTLAE GVPSRFSGSGSGTQFSLKINSLQPEDFGSYYCQHHYVPPYTFGGGTKLEIK |
| 97 | | scFv | aa | EVQLVEQSGAELVKPGASVKISCKASGYAFSTSWMNWVKQRPGKGLEWIGRIYPGD GETKYNGKFKGKATLTADKSSSTAYMQLSSLTSEDSAVYFCARQRDYGALYALDY WGQGTRVTVSSGGGGSGGGGSGGGGSELMMTQTPASLSASVGETVTFTCRASENIY SYLAWYQQKQGKSPQLLVYNAKTLAEGVPSRFSGSGSGTQFSLKINSLQPEDFGSYY CQHHYVPPYTFGGGTKLEIK |
| 98 | | bispecific molecule | aa | EVQLVEQSGAELVKPGASVKISCKASGYAFSTSWMNWVKQRPGKGLEWIGRIYPGD GETKYNGKFKGKATLTADKSSSTAYMQLSSLTSEDSAVYFCARQRDYGALYALDY WGQGTRVTVSSGGGGSGGGGSGGGGSELMMTQTPASLSASVGETVTFTCRASENIY SYLAWYQQKQGKSPQLLVYNAKTLAEGVPSRFSGSGSGTQFSLKINSLQPEDFGSYY CQHHYVPPYTFGGGTKLEIKRTGGGGSEVQLVESGGGLVQPGGSLKLSCAASGFTFN KYAMNWVRQAPGKGLEWVARIRSKYNNYATYYADSVKDRFTISRDDSKNTAYLQ MNNLKTEDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVLHH HHHH |
| 99 | D1B CDH3-6 | VH CDR1 | aa | SSWMN |
| 100 | | VH CDR2 | aa | RIYPGDGETKYNGKFKG |
| 101 | | VH CDR3 | aa | QRDYGALYAMDY |
| 102 | | VL CDR1 | aa | RASDDIYSYLA |

| SEQ ID NO | Epitope | Designation | Format/Source | Type | Sequence |
|---|---|---|---|---|---|
| 103 | | | VL CDR2 | aa | NAKTLAE |
| 104 | | | VL CDR3 | aa | QNHYVTPFT |
| 105 | | | VH | aa | EVQLVEESGPELVKPGASVKISCKASGYAFSSSWMNWVKQRPGKGLEWIGRIYPGD GETKYNGKFKGKATLTADKSSSTAYMQLSSLTSEDSAVYFCARQRDYGALYAMDY WGQGTSVTVSS |
| 106 | | | VL | aa | ELVMTQSPASLSASVGETVTITCRASDDIYSYLAWYQQKQGKSPQLLVYNAKTLAEG VPSRFSGSGSGTQFSLKINSLQPEDFGTYYCQNHYVTPFTFGAGTKLEIK |
| 107 | | | scFv | aa | EVQLVEESGPELVKPGASVKISCKASGYAFSSSWMNWVKQRPGKGLEWIGRIYPGD GETKYNGKFKGKATLTADKSSSTAYMQLSSLTSEDSAVYFCARQRDYGALYAMDY WGQGTSVTVSSGGGGSGGGGSGGGGSELVMTQSPASLSASVGETVTITCRASDDIYS YLAWYQQKQGKSPQLLVYNAKTLAEGVPSRFSGSGSGTQFSLKINSLQPEDFGTYYC QNHYVTPFTFGAGTKLEIK |
| 108 | | | bispecific molecule | aa | EVQLVEESGPELVKPGASVKISCKASGYAFSSSWMNWVKQRPGKGLEWIGRIYPGD GETKYNGKFKGKATLTADKSSSTAYMQLSSLTSEDSAVYFCARQRDYGALYAMDY WGQGTSVTVSSGGGGSGGGGSGGGGSELVMTQSPASLSASVGETVTITCRASDDIYS YLAWYQQKQGKSPQLLVYNAKTLAEGVPSRFSGSGSGTQFSLKINSLQPEDFGTYYC QNHYVTPFTFGAGTKLEIKRTGGGGSEVQLVESGGGLVQPGGSLKLSCAASGFTFNK YAMNWVRQAPGKGLEWVARIRSKYNNYATYYADSVKDRFTISRDDSKNTAYLQM NNLKTEDTAVYYCVRHGNFGNSYISYWAYWGQGTLVTVSSGGGGSGGGGSGGGGS QTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVLHHHH HH |
| 109 | D1B | CDH3-7 | VH CDR1 | aa | SSWMN |
| 110 | | | VH CDR2 | aa | RIYPGDGETKYNGKFKG |
| 111 | | | VH CDR3 | aa | QRDYGALYAMDY |
| 112 | | | VL CDR1 | aa | RLSENIYSYLA |
| 113 | | | VL CDR2 | aa | NSKTLAE |
| 114 | | | VL CDR3 | aa | QNHYGFPFT |
| 115 | | | VH | aa | EVQLVEQSGAELVKPGASVKISCKASGYAFSSSWMNWKQRPGKGLEWIGRIYPGD GETKYNGKFKGKATLTADKSSSTAYMQLSTLTSEDSAVYFCARQRDYGALYAMDY WGQGTSVTVSS |
| 116 | | | VL | aa | ELQMTQSPASLSASVGETVTITCRLSENIYSYLAWYRQKEGESPQLLVYNSKTLAEGV PSRFSGSGSGTQFSLKINSLQPEDFGNYYCQNHYGFPFTFGAGTKLEIK |
| 117 | | | scFv | aa | EVQLVEQSGAELVKPGASVKISCKASGYAFSSSWMNWVKQRPGKGLEWIGRTYPGD GETKYNGKFKGKATLTADKSSSTAYMQLSTLTSEDSAVYFCARQRDYGALYAMDY WGQGTSVTVSSGGGGSGGGGSGGGGSELQMTQSPASLSASVGETVTITCRLSENIYS YLAWYRQKEGESPQLLVYNSKTLAEGVPSRFSGSGSGTQFSLKINSLQPEDFGNYYC QNHYGFPFTFGAGTKLEIK |
| 118 | | | bispecific molecule | aa | EVQLVEQSGAELVKPGASVKISCKASGYAFSSSWMNWVKQRPGKGLEWIGRIYPGD GETKYNGKFKGKATLTADKSSSTAYMQLSTLTSEDSAVYFCARQRDYGALYAMDY WGQGTSVTVSSGGGGSGGGGSGGGGSELQMTQSPASLSASVGETVTITCRLSENIYS YLAWYRQKEGESPQLLVYNSKTLAEGVPSRFSGSGSGTQFSLKINSLQPEDFGNYYC QNHYGFPFTFGAGTKLEIKRTGGGGSEVQLVESGGGLVQPGGSLKLSCAASGFTFNK YAMNWVRQAPGKGLEWVARIRSKYNNYATYYADSVKDRFTISRDDSKNTAYLQM NNLKTEDTAVYYCVRHGNFGNSYISYWAYWGQGTLVTVSSGGGGSGGGGSGGGGS QTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVLHHHH HH |

-continued

| | | BAYER II SEQUENCES | | |
|---|---|---|---|---|
| SEQ ID NO | Epitope Designation | Format/ Source | Type | Sequence |
| 119 | D1B CDH3-8 | VH CDR1 | aa | SYWMN |
| 120 | | VH CDR2 | aa | HIYPGDGDTNYNGKFKG |
| 121 | | VH CDR3 | aa | DRGSFGAWFAY |
| 122 | | VL CDR1 | aa | RASQDISNYLN |
| 123 | | VL CDR2 | aa | YTSRLHS |
| 124 | | VL CDR3 | aa | QQGNRNPPT |
| 125 | | VH | aa | EVQLVEQSGAEVVKPGASVKITCKASGYAFSSYWMNWVRQRPGKGLEWIGHIYPGD GDTNYNGKFKGKVTLTADKSSNTAYMQLSDLTPEDSAVYFCARDRGSFGAWFAYW GQGTTVTVSS |
| 126 | | VL | aa | ELVMTQTPSSLSASLGDRVTISCRASQDISNYLNWYQQKPDGTVKLLIYYTSRLHSGV PSRFSGSGSGTDYSLTISNLEQEDIATYFCQQGNRNPPTFGGGTKLEIK |
| 127 | | scFv | aa | EVQLVEQSGAEVVKPGASVKITCKASGYAFSSYWMNWVRQRPGKGLEWIGHIYPGD GDTNYNGKFKGKVTLTADKSSNTAYMQLSDLTPEDSAVYFCARDRGSFGAWFAYW GQGTTVTVSSGGGGSGGGGSGGGGSELVMTQTPSSLSASLGDRVTISCRASQDISNYL NWYQQKPDGTVKLLIYYTSRLHSGVPSRFSGSGSGTDYSLTISNLEQEDIATYFCQQG NRNPPTFGGGTKLEIK |
| 128 | | bispecific molecule | aa | EVQLVEQSGAEVVKPGASVKITCKASGYAFSSYWMNWVRQRPGKGLEWIGHIYPGD GDTNYNGKFKGKVTLTADKSSNTAYMQLSDLTPEDSAVYFCARDRGSFGAWFAYW GQGTTVTVSSGGGGSGGGGSGGGGSELVMTQTPSSLSASLGDRVTISCRASQDISNYL NWYQQKPDGTVKLLIYYTSRLHSGVPSRFSGSGSGTDYSLTISNLEQEDIATYFCQQG NRNPPTFGGGTKLEIKRTSGGGGSEVQLVESGGGLVQPGGSLKLSCAASGFTFNKYA MNWVRQAPGKGLEWVARIRSKYNNYATYYADSVKDRFTISRDDSKNTAYLQMNNL KTEDTAVYYCVRHGNFGNSYISYWAYWGQGTLVTVSSGGGGSGGGGSGGGGSQTV VTQEPSLTVSPGGTVTLTCGSSTGAVTSGNYPNWVQQKPGQAPRGLIGGTKFLAPGT PARFSGSLLGGKAALTLSGVQPEDEAEYYCVLWYSNRWVFGGGTKLTVLHHHHHH |
| 129 | D1B CDH3-9 | VH CDR1 | aa | TYGMS |
| 130 | | VH CDR2 | aa | TISSGGHYSYYPDSVKG |
| 131 | | VH CDR3 | aa | YYYGSPFAY |
| 132 | | VL CDR1 | aa | RASQDIGSSLN |
| 133 | | VL CDR2 | aa | DTSSLDS |
| 134 | | VL CDR3 | aa | VQYGSSPLT |
| 135 | | VH | aa | EVQLVEESGGDLVKPGGSLKLSCAASGFTFSTYGMSWVRQTPDKRLEWVATISSGG HYSYYPDSVKGRFTISRDNAKNTLYLQMSSLKSEDTAMYYCASYYYGSPFAYWGQG TTVTVSS |
| 136 | | VL | aa | ELQMTQSPSSLSASLGERVSLTCRASQDIGSSLNWLQQKPDGTIKRLIYDTSSLDSGVP KRFSGSRSGSDYSLTISSLESEDFGDYYCVQYGSSPLTFGAGTKLEIK |
| 137 | | scFv | aa | EVQLVEESGGDLVKPGGSLKLSCAASGFTFSTYGMSWVRQTPDKRLEWVATISSGG HYSYYPDSVKGRFTISRDNAKNTLYLQMSSLKSEDTAMYYCASYYYGSPFAYWGQG TTVTVSSGGGGSGGGGSGGGGSELQMTQSPSSLSASLGERVSLTCRASQDIGSSLNW LQQKPDGTIKRLIYDTSSLDSGVPKRFSGSRSGSDYSLTISSLESEDFGDYYCVQYGSS PLTFGAGTKLEIK |

BAYER II SEQUENCES

| SEQ ID NO | Epitope | Designation | Format/Source | Type | Sequence |
|---|---|---|---|---|---|
| 138 | | | bispecific molecule | aa | EVQLVEESGGDLVKPGGSLKLSCAASGFTFSTYGMSWVRQTPDKRLEWVATISSGG HYSYYPDSVKGRFTISRDNAKNTLYLQMSSLKSEDTAMYYCASYYYGSPFAYWGQG TTVTVSSGGGGSGGGGSGGGGSELQMTQSPSSLSASLGERVSLTCRASQDIGSSLNW LQQKPDGTIKRLIYDTSSLDSGVPKRFSGSRSGSDYSLTISSLESEDFGDYYCVQYGSS PLTFGAGTKLEIKRTSGGGGSEVQLVESGGGLVQPGGSLKLSCAASGFTFNKYAMN WVRQAPGKGLEWVARIRSKYNNYATYYADSVKDRFTISRDDSKNTAYLQMNNLKT EDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVLHHHHHH |
| 139 | D1B | CDH3-10 | VH CDR1 | aa | SYAMS |
| 140 | | | VH CDR2 | aa | TISSGGHYTYYPDSVKG |
| 141 | | | VH CDR3 | aa | YYYGIPFGY |
| 142 | | | VL CDR1 | aa | RASQDIGINLI |
| 143 | | | VL CDR2 | aa | DTSSLDS |
| 144 | | | VL CDR3 | aa | LQYGSSPLT |
| 145 | | | VH | aa | EVQLVEESGGGLVKPGGSLKLSCAASGFTFSSYAMSWVRQTPDKRLEWVATISSGGH YTYYPDSVKGRFTISRDNAKNTLYLQMSSLKSEDTAMYYCASYYYGIPFGYWGQGT TVTVSS |
| 146 | | | VL | aa | ELVMTQSPSSLSASLGEGVSLTCRASQDIGINLIWLRQEPDGTIKRLIYDTSSLDSGVPK RFSGSRSGSDYSLTISSLESEDFVHYYCLQYGSSPLTFGAGTKLEIK |
| 147 | | | scFv | aa | EVQLVEESGGGLVKPGGSLKLSCAASGFTFSSYAMSWVRQTPDKRLEWVATISSGGH YTYYPDSVKGRFTISRDNAKNTLYLQMSSLKSEDTAMYYCASYYYGIPFGYWGQGT TVTVSSGGGGSGGGGSGGGGSELVMTQSPSSLSASLGEGVSLTCRASQDIGINLIWLR QEPDGTIKRLIYDTSSLDSGVPKRFSGSRSGSDYSLTISSLESEDFVHYYCLQYGSSPLT FGAGTKLEIK |
| 148 | | | bispecific molecule | aa | EVQLVEESGGGLVKPGGSLKLSCAASGFTFSSYAMSWVRQTPDKRLEWVATISSGGH YTYYPDSVKGRFTISRDNAKNTLYLQMSSLKSEDTAMYYCASYYYGIPFGYWGQGT TVTVSSGGGGSGGGGSGGGGSELVMTQSPSSLSASLGEGVSLTCRASQDIGINLIWLR QEPDGTIKRLIYDTSSLDSGVPKRFSGSRSGSDYSLTISSLESEDFVHYYCLQYGSSPLT FGAGTKLEIKRTSGGGGSEVQLVESGGGLVQPGGSLKLSCAASGFTFNKYAMNWVR QAPGKGLEWVARIRSKYNNYATYYADSVKDRFTISRDDSKNTAYLQMNNLKTEDTA VYYCVRHGNFGNSYISYWAYWGQGTLVTVSSGGGGSGGGGSGGGGSQTVVTQEPS LTVSPGGTVTLTCGSSTGAVTSGNYPNWVQQKPGQAPRGLIGGTKFLAPGTPARFSG SLLGGKAALTLSGVQPEDEAEYYCVLWYSNRWVFGGGTKLTVLHHHHHH |
| 149 | D2C | CDH3-11 | VH CDR1 | aa | SYPIN |
| 150 | | | VH CDR2 | aa | VIWTGGGTNYASSVKG |
| 151 | | | VH CDR3 | aa | SRGVYDFDGRGAMDY |
| 152 | | | VL CDR1 | aa | KSSQSLLYSSNQKNYLA |
| 153 | | | VL CDR2 | aa | WASTRES |
| 154 | | | VL CDR3 | aa | QQYYSYPYT |
| 155 | | | VH | aa | EVQLLESGGGLVQPGGSLRLSCAVSGFTLSSYPINWVRQAPGKGLEWVSVIWTGGGT NYASSVKGRFTISRDNSKNTLYLQMNSLRAEDTAVYYCAKSRGVYDFDGRGAMDY WGQGTLVTVSS |

-continued

| BAYER II SEQUENCES | | | | | |
|---|---|---|---|---|---|
| SEQ ID NO | Epitope | Designation | Format/ Source | Type | Sequence |
| 156 | | | VL | aa | DIVMTQSPDSLAVSVGERVTINCKSSQSLLYSSNQKNYLAWYQQKPGQPPKLLIYWA STRESGVPDRFSGSGSGTDFTLTISSLQAEDVAVYYCQQYYSYPYTFGQGTKLEIK |
| 157 | | | scFv | aa | EVQLLESGGGLVQPGGSLRLSCAVSGFTLSSYPINWVRQAPGKGLEWVSVINVTGGGT NYASSVKGRFTISRDNSKNTLYLQMNSLRAEDTAVYYCAKSRGVYDFDGRGAMDY WGQGTLVTVSSGGGGSGGGGSGGGGSDIVMTQSPDSLAVSVGERVTINCKSSQSLLY SSNQKNYLAWYQQKPGQPPKLLIYWASTRESGVPDRFSGSGSGTDFTLTISSLQAEDV AVYYCQQYYSYPYTFGQGTKLEIK |
| 158 | | | bispecific molecule | aa | EVQLLESGGGLVQPGGSLRLSCAVSGFTLSSYPINVVVRQAPGKGLEWVSVINVTGGGT NYASSVKGRFTISRDNSKNTLYLQMNSLRAEDTAVYYCAKSRGVYDFDGRGAMDY WGQGTLVTVSSGGGGSGGGGSGGGGSDIVMTQSPDSLAVSVGERVTINCKSSQSLLY SSNQKNYLAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGGSQTWTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL |
| 159 | D2C | CDH3-12 | VH CDR1 | aa | SYPIN |
| 160 | | | VH CDR2 | aa | VIWTGGGTNYNPSLKS |
| 161 | | | VH CDR3 | aa | SRGVYDFDGRGAMDY |
| 162 | | | VL CDR1 | aa | KSSQSLLYSSNQKNYLA |
| 163 | | | VL CDR2 | aa | WASTRES |
| 164 | | | VL CDR3 | aa | QQYYSYPYT |
| 165 | | | VH | aa | QVQLQESGPGLVKPSETLSLTCTVSGVSITSYPINWIRQPPGKGLEWIGVIWTGGGTN YNPSLKSRVTISVDTSKNQFSLKLSSVTAADTAVYYCARSRGVYDFDGRGAMDYWG QGTLVTVSS |
| 166 | | | VL | aa | DIVMTQSPASLAVSLGERATINCKSSQSLLYSSNQKNYLAWYQQKPGQPPKLLIYWA STRESGVPDRFSGSGSGTDFTLTISSLQAEDVAVYYCQQYYSYPYTFGQGTKLEIK |
| 167 | | | scFv | aa | QVQLQESGPGLVKPSETLSLTCTVSGVSITSYPINWIRQPPGKGLEWIGVIWTGGGTN YNPSLKSRVTISVDTSKNQFSLKLSSVTAADTAVYYCARSRGVYDFDGRGAMDYWG QGTLVTVSSGGGGSGGGGSGGGGSDIVMTQSPASLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIK |
| 168 | | | bispecific molecule | aa | QVQLQESGPGLVKPSETLSLTCTVSGVSITSYPINWIRQPPGKGLEWIGNTIWTGGGTN YNPSLKSRVTISVDTSKNQFSLKLSSVTAADTAVYYCARSRGVYDFDGRGAMDYWG QGTLVTVSSGGGGSGGGGSGGGGSDIVMTQSPASLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIKSGGGGSEVQLVESGGGLVQPGGSLRLSCAASGFTFT NSYAMNWVRQAPGKGLEWVARIRSKYNNYATYYADSVKGRFTISRDDSKNTAYLQ MNSLKTEDTAVYYCVRHGNFGNSYVSWWAYWGQGTLVTVSSGGGGSGGGGSGGG GSQTVVTQEPSLTVSPGGTVTLCGSSTGAVTSGNYPNWVQQKPGQAPRGLIGGTKF LAPGTPARFSGSLLGGKAALTLSGVQPEDEAEYYCVLWYSNRWVFGGGTKLTVL |
| 169 | D2C | CDH3-13 | VH CDR1 | aa | SYPIN |
| 170 | | | VH CDR2 | aa | VIWTGGGTNYASSVKG |
| 171 | | | VH CDR3 | aa | SRGVYDFDGRGAMDY |
| 172 | | | VL CDR1 | aa | KSSQSLLYSSNQKNVFA |

BAYER II SEQUENCES

| SEQ ID NO | Epitope | Designation | Format/Source | Type | Sequence |
|---|---|---|---|---|---|
| 173 | | | VL CDR2 | aa | WASTRES |
| 174 | | | VL CDR3 | aa | QQYYSYPYT |
| 175 | | | VH | aa | EVQLLESGGGLVQPGGSLRLSCAASGFSFSSYPMWVRQAPGKGLEWVGVIWTGGGT NYASSVKGRFTISRDNSKNTVYLQMNSLRAEDTAVYYCAKSRGVYDFDGRGAMDY WGQGTLVTVSS |
| 176 | | | VL | aa | DIVMTQSPDSLAVSLGERATINCKSSQSLLYSSNQKNYFAWYQQKPGQPPKLLIYWA STRESGVPDRFSGSGSTDFTLTISSLQAEDVAVYYCQQYYSYPYTFGQGTKLEIK |
| 177 | | | scFv | aa | EVQLLESGGGLVQPGGSLRLSCAASGFSFSSYPINWVRQAPGKGLEWVGVIWTGGGT NYASSVKGRFTISRDNSKNTVYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYFAWYQQKPGQPPKLLIYWASTRESGVPDRFSGSGSTDFTLTISSLQAEDV AVYYCQQYYSYPYTFGQGTKLEIK |
| 178 | | | bispecific molecule | aa | EVQLLESGGGLVQPGGSLRLSCAASGFSFSSYPINWVRQAPGKGLEWVGVIWTGGGT NYASSVKGRFTISRDNSKNTVYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYFAWYQQKPGQPPKLLIYWASTRESGVPDRFSGSGSTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL |
| 179 | D2C | CDH3-14 | VH CDR1 | aa | SYPIN |
| 180 | | | VH CDR2 | aa | VIWTGGGTNYNPSLKS |
| 181 | | | VH CDR3 | aa | SRGVYDFDGRGAMDY |
| 182 | | | VL CDR1 | aa | KSSQSLLYSSNQKNYLA |
| 183 | | | VL CDR2 | aa | WASTRES |
| 184 | | | VL CDR3 | aa | QQYYSYPYT |
| 185 | | | VH | aa | QVQLQESGPGLVKPSETLSLTCTVSGGSITSYPINWIRQPPGKGLEWIGVIWTGGGTN YNPSLKSRVTISVDTSKNQFSLKLSSVTAADTAVYYCARSRGVYDFDGRGAMDYWG QGTLVTVSS |
| 186 | | | VL | aa | DIVMTQSPDSLAVSLGERATINCKSSQSLLYSSNQKNYLAWYQQKPGQPPKLLIYWA STRESGVPDRFSGSGSTDFTLTISSLQAEDVAVYYCQQYYSYPYTFGQGTKLEIK |
| 187 | | | scFv | aa | QVQLQESGPGLVKPSETLSLTCTVSGGSITSYPINWIRQPPGKGLEWIGVIWTGGGTN YNPSLKSRVTISVDTSKNQFSLKLSSVTAADTAVYYCARSRGVYDFDGRGAMDYWG QGTLVTVSSGGGGSGGGGSGGGGSDIVMTQSPDSLAVSLGERATINCKSSQSLLYSSN QKNYLAWYQQKPGQPPKLLIYWASTRESGVPDRFSGSGSTDFTLTISSLQAEDVAV YYCQQYYSYPYTFGQGTKLEIK |
| 188 | | | bispecific molecule | aa | QVQLQESGPGLVKPSETLSLTCTVSGGSITSYPINWIRQPPGKGLEWIGVIWTGGGTN YNPSLKSRVTISVDTSKNQFSLKLSSVTAADTAVYYCARSRGVYDFDGRGAMDYWG QGTLVTVSSGGGGSGGGGSGGGGSDIVMTQSPDSLAVSLGERATINCKSSQSLLYSSN QKNYLAWYQQKPGQPPKLLIYWASTRESGVPDRFSGSGSTDFTLTISSLQAEDVAV YYCQQYYSYPYTFGQGTKLEIKSGGGGSEVQLVESGGGLVQPGGSLRLSCAASGFTF NSYAMNWVRQAPGKGLEWVARIRSKYNNYATYYADSVKGRFTISRDDSKNTAYLQ MNSLKTEDTAVYYCVRHGNFGNSYVSWWAYWGQGTLVTVSSGGGGSGGGGSGGG GSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVL |

BAYER II SEQUENCES

| SEQ ID NO | Epitope | Designation | Format/Source | Type | Sequence |
|---|---|---|---|---|---|
| 189 | D2C | CDH3-15 | VH CDR1 | aa | SYPIN |
| 190 | | | VH CDR2 | aa | VIWTGGGTNYASSVKG |
| 191 | | | VH CDR3 | aa | SRGVYDFDGRGAMDY |
| 192 | | | VL CDR1 | aa | KSSQSLLYSSNQKNYLA |
| 193 | | | VL CDR2 | aa | WASTRES |
| 194 | | | VL CDR3 | aa | QQYYSYPYT |
| 195 | | | VH | aa | EVQLLESGGGLVQPGGSLRLSCAASGFTFSSYPINWVRQAPGKGLEWVSVIWTGGGT NYASSVKGRFTISRDNSKNTLYLQMNSLRAEDTAVYYCAKSRGVYDFDGRGAMDY WGQGTLVTVSS |
| 196 | | | VL | aa | DIVMTQSPDSLAVSLGERATINCKSSQSLLYSSNQKNYLAWYQQKPGQPPKLLIYWA STRESGVPDRFSGSGSGTDFTLTISSVQAEDVAVYYCQQYYSYPYTFGQGTKLEIK |
| 197 | | | scFv | aa | EVQLLESGGGLVQPGGSLRLSCAASGFTFSSYPINWVRQAPGKGLEWVSVIWTGGGT NYASSVKGRFTISRDNSKNTLYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYLAWYQQKPGQPPKLLIYWASTRESGVPDRFSGSGSGTDFTLTISSVQAED VAVYYCQQYYSYPYTFGQGTKLEIK |
| 198 | | | bispecific molecule | aa | EVQLLESGGGLVQPGGSLRLSCAASGFTFSSYPINWVRQAPGKGLEWVSVIWTGGGT NYASSVKGRFTISRDNSKNTLYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYLAWYQQKPGQPPKLLIYWASTRESGVPDRFSGSGSGTDFTLTISSVQAED VAVYYCQQYYSYPYTFGQGTKLEIKSGGGGSEVQLVESGGGLVQPGGSLKLSCAAS GFTFNKYAMNWVRQAPGKGLEWVARIRSKYNNYATYYADSVKDRFTISRDDSKNT AYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGNYPNWVQQKPGQAPRGLIG GTKFLAPGTPARFSGSLLGGKAALTLSGVQPEDEAEYYCVLWYSNRWVFGGGTKLT VL |
| 199 | D2C | CDH3-16 | VH CDR1 | aa | SYPIN |
| 200 | | | VH CDR2 | aa | VIWTGGGTNYNPSLKS |
| 201 | | | VH CDR3 | aa | SRGVYDFDGRGAMDY |
| 202 | | | VL CDR1 | aa | KSSQSLLYSSNQKNYLA |
| 203 | | | VL CDR2 | aa | WASTRES |
| 204 | | | VL CDR3 | aa | QQYYSYPYT |
| 205 | | | VH | aa | QVQLQESGPGLVKPSETLSLTCTVSGGSITSYNNWIRQPPGKGLEWIGVIWTGGGTN YNPSLKSRVTISVDTSKNQVSLKLSSVTAADTAVYYCARSRGVYDFDGRGAMDYWG QGTLVTVSS |
| 206 | | | VL | aa | DIVMTQSPDSLAVSLGERATINCKSSQSLLYSSNQKNYLAWYQQKPGQPPKLLIYWA STRESGVPDRFSGSGSGTDFTLTISSLQAEDVAVYYCQQYYSYPYTFGQGTKLEIK |
| 207 | | | scFv | aa | QVQLQESGPGLVKPSETLSLTCTVSGGSITSYPINWIRQPPGKGLEWIGVIWTGGGTN YNPSLKSRVTISVDTSKNQVSLKLSSVTAADTAVYYCARSRGVYDFDGRGAMDYWG QGTLVTVSSGGGGSGGGGSGGGGSDIVMTQSPDSLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIK |

| SEQ ID NO | Epitope | Designation | Format/ Source | Type | Sequence |
|---|---|---|---|---|---|
| 208 | | | bispecific molecule | aa | QVQLQESGPGLVKPSETLSLTCTVSGGSITSYPINWIRQPPGKGLEWIGVIWTGGGTN YNPSLKSRVTISVDTSKNQVSLKLSSVTAADTAVYYCARSRGVYDFDGRGAMDYWG QGTLVTVSSGGGGSGGGGSGGGGSDIVMTQSPDSLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIKSGGGGSEVQLVESGGGLVQPGGSLRLSCAASGFTF NSYAMNWVRQAPGKGLEWVARIRSKYNNYATYYADSVKGRFTISRDDSKNTAYLQ MNSLKTEDTAVYYCVRHGNFGNSYVSWWAYWGQGTLVTVSSGGGGSGGGGSGGG GSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVL |
| 209 | D2C | CDH3-17 | VH CDR1 | aa | SYPIN |
| 210 | | | VH CDR2 | aa | VIWTGGGTNYASSVKG |
| 211 | | | VH CDR3 | aa | SRGVYDFDGRGAMDY |
| 212 | | | VL CDR1 | aa | KSSQSLLYSSNQKNYLA |
| 213 | | | VL CDR2 | aa | WASTRES |
| 214 | | | VL CDR3 | aa | QQYYSYPYT |
| 215 | | | VH | aa | EVQLLESGGGLVPPGGSLRLSCAVSGFTFSSYPINWVRQAPGKGLEWVGVIWTGGGT NYASSVKGRFTISRDNSKNTLFLQMNSLRAEDTAVYYCAKSRGVYDFDGRGAMDY WGQGTLVTVSS |
| 216 | | | VL | aa | DIVMTQSPDSLAVSVGERATINCKSSQSLLYSSNQKNYLAWYQQKPGQPPKLLIYWA STRESGVPDRFSGSGSGTDFTLTISSLQAEDVAVYYCQQYYSYPYTFGQGTKLEIK |
| 217 | | | scFv | aa | EVQLLESGGGLVPPGGSLRLSCAVSGFTFSSYPINWVRQAPGKGLEWVGVIWTGGGT NYASSVKGRFTISRDNSKNTLFLQMNSLRAEDTAVYYCAKSRGVYDFDGRGAMDY WGQGTLVTVSSGGGGSGGGGSGGGGSDIVMTQSPDSLAVSVGERATINCKSSQSLLY SSNQKNYLAWYQQKPGQPPKLLIYWASTRESGVPDRFSGSGSGTDFTLTISSLQAEDV AVYYCQQYYSYPYTFGQGTKLEIK |
| 218 | | | bispecific molecule | aa | EVQLLESGGGLVPPGGSLRLSCAVSGFTFSSYPINWVRQAPGKGLEWVGVIWTGGGT NYASSVKGRFTISRDNSKNTLFLQMNSLRAEDTAVYYCAKSRGVYDFDGRGAMDY WGQGTLVTVSSGGGGSGGGGSGGGGSDIVMTQSPDSLAVSVGERATINCKSSQSLLY SSNQKNYLAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL |
| 219 | D2C | CDH3-18 | VH CDR1 | aa | SYPIN |
| 220 | | | VH CDR2 | aa | VIWTGGGTNYASSVKG |
| 221 | | | VH CDR3 | aa | SRGAYDFDGRGAMDY |
| 222 | | | VL CDR1 | aa | KSSQSLLYSSNQKNYLA |
| 223 | | | VL CDR2 | aa | WASTRES |
| 224 | | | VL CDR3 | aa | QQYYSYPYT |
| 225 | | | VH | aa | EVQLLESGGGLVQPGGSLRLSCAASGFTFSSYPINWVRQAPGKGLEWVGVIWTGGGT NYASSVKGRFTISRDNSKNTLYLQMNSLRAEDTAVYYCAKSRGAYDFDGRGAMDY WGQGTLVTVSS |

BAYER II SEQUENCES

| SEQ ID NO | Epitope | Designation | Format/Source | Type | Sequence |
|---|---|---|---|---|---|
| 226 | | | VL | aa | DIVMTQSPDSLAVSLGEKATINCKSSQSLLYSSNQKNYLAWQQKPGQPPKLLIYWASTRESGVPDRFSGSGSGTDFTLTISSLQAEDVAVYYCQQYYSYPYTFGQGTKLEIK |
| 227 | | | scFv | aa | EVQLLESGGGLVQPGGSLRLSCAASGFTFSSYPINWVRQAPGKGLEWVGVIWTGGGTNYASSVKGRFTISRDNSKNTLYLQNINSLRAEDTAVYYCAKSRGAYDFDGRGAMDYWGQGTLVTVSSGGGGSGGGGSGGGGSDIVMTQSPDSLAVSLGEKATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK |
| 228 | | | bispecific molecule | aa | EVQLLESGGGLVQPGGSLRLSCAASGFTFSSYPINWVRQAPGKGLEWVGVIWTGGGTNYASSVKGRFTISRDNSKNTLYLQMNSLRAEDTAVYYCAKSRGAYDFDGRGAMDYWGQGTLVTVSSGGGGSGGGGSGGGGSDIVMTQSPDSLAVSLGEKATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 229 | D2C | CDH3-19 | VH CDR1 | aa | SYPIN |
| 230 | | | VH CDR2 | aa | VIWTGGGTNYASSVKG |
| 231 | | | VH CDR3 | aa | SRGVYDFDGRGAMDY |
| 232 | | | VL CDR1 | aa | KSSQSLLYSSNQKNYLA |
| 233 | | | VL CDR2 | aa | WASTRES |
| 234 | | | VL CDR3 | aa | QQYYSYPYT |
| 235 | | | VH | aa | EVQLLESGGGLVQPGGSLRLSCAASGFSFSSYPINWVRQAPGKGLEWLSVIWTGGGTNYASSVKGRFTISRDNSKNTLYLQMNSLRAEDTAVYYCAKSRGVYDFDGRGAMDYWGQGTLVTVSS |
| 236 | | | VL | aa | DIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIK |
| 237 | | | scFv | aa | EVQLLESGGGLVQPGGSLRLSCAASGFSFSSYPINWVRQAPGKGLEWLSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIK |
| 238 | | | bispecific molecule | aa | EVQLLESGGGLVQPGGSLRLSCAASGFSFSSYPINWVRQAPGKGLEWLSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLVVYSNRWVFGGGTKLTVL |
| 239 | D2C | CDH3-20 | VH CDR1 | aa | SYPIN |
| 240 | | | VH CDR2 | aa | VIWTGGGTNYADSVKG |
| 241 | | | VH CDR3 | aa | RGVYDFDGRGAMDY |
| 242 | | | VL CDR1 | aa | KSSQSLLYSSNQKNYLA |

BAYER II SEQUENCES

| SEQ ID NO | Epitope | Designation | Format/Source | Type | Sequence |
|---|---|---|---|---|---|
| 243 | | | VL CDR2 | aa | WASTRES |
| 244 | | | VL CDR3 | aa | QQYYSYPYT |
| 245 | | | VH | aa | EVQLLESGGGLVQPGGSLRLSCAASGFTFSSYPINWVRQAPGKGLEWVSVIWTGGGT NYADSVKGRFTISRDNSKNTLYLQMNSLRAEDTAVYYCAKRGVYDFDGRGAMDY WGQGTLVTVSS |
| 246 | | | VL | aa | DIVMTQSPDSLAVSLGERATINCKSSQSLLYSSNQKNYLAWYQQKPGQPPKLLIYWA STRESGVPDRFSGSGSGTDFTLTISSLQAEDVAVYYCQQYYSYPYTFGQGTKLEIK |
| 247 | | | scFv | aa | EVQLLESGGGLVQPGGSLRLSCAASGFTFSSYPINWVRQAPGKGLEWVSVIWTGGGT NYADSVKGRFTISRDNSKNTLYLQMNSLRAEDTAVYYCAKRGVYDFDGRGAMDY WGQGTLVTVSSGGGGSGGGGSGGGGSDIVMTQSPDSLAVSLGERATINCKSSQSLLY SSNQKNYLAWYQQKPGQPPKLLIYWASTRESGVPDRFSGSGSGTDFTLTISSLQAEDV AVYYCQQYYSYPYTFGQGTKLEIK |
| 248 | | | bispecific molecule | aa | EVQLLESGGGLVQPGGSLRLSCAASGFTFSSYPINWVRQAPGKGLEWVSVIWTGGGT NYADSVKGRFTISRDNSKNTLYLQMNSLRAEDTAVYYCAKRGVYDFDGRGAMDY WGQGTLVTVSSGGGGSGGGGSGGGGSDIVMTQSPDSLAVSLGERATINCKSSQSLLY SSNQKNYLAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL |
| 249 | D2C | CDH3-21 | VH CDR1 | aa | SYPIN |
| 250 | | | VH CDR2 | aa | VIWTGGGTNYNSALKS |
| 251 | | | VH CDR3 | aa | SRGVYDFDGRGAMDY |
| 252 | | | VL CDR1 | aa | KSSQSLLYSSNQKNYLA |
| 253 | | | VL CDR2 | aa | WASTRES |
| 254 | | | VL CDR3 | aa | QQYYSYPYT |
| 255 | | | VH | aa | EVQLLEESGPGLVTPSQSLSITCTVSGFSLTSYPINWVRQPPGKGLEWLGVIWTGGGT NYNSALKSRLSITKDNSKSQVFLKMTSLQTDDTARYYCAKSRGVYDFDGRGAMDY WGQGTTVTVSS |
| 256 | | | VL | aa | ELVMTQSPSSLAVSVGEKVTMSCKSSQSLLYSSNQKNYLAWYQQKPGQSPKLLIYW ASTRESGVPDRFTGSGSGTDFTLTISSVKAEDLAVYYCQQYYSYPYTFGGGTKLEIK |
| 257 | | | scFv | aa | EVQLLEESGPGLVTPSQSLSITCTVSGFSLTSYPINWVRQPPGKGLEWLGVIWTGGGT NYNSALKSRLSITKDNSKSQVFLKMTSLQTDDTARYYCAKSRGVYDFDGRGAMDY WGQGTTVTVSSGGGGSGGGGSGGGGSELVMTQSPSSLAVSVGEKVTMSCKSSQSLL YSSNQKNYLAWYQQKPGQSPKLLIYWASTRESGVPDRFTGSGSGTDFTLTISSVKAE DLAVYYCQQYYSYPYTFGGGTKLEIK |
| 258 | | | bispecific molecule | aa | EVQLLEESGPGLVTPSQSLSITCTVSGFSLTSYPINWVRQPPGKGLEWLGVIWTGGGT NYNSALKSRLSITKDNSKSQVFLKMTSLQTDDTARYYCAKSRGVYDFDGRGAMDY WGQGTTVTVSSGGGGSGGGGSGGGGSELVMTQSPSSLAVSVGEKVTMSCKSSQSLL YSSNQKNYLAWYQQKPGQSPKLLIYWASTRESGVPDRFTGSGSGTDFTLTISSVKAE DLAVYYCQQYYSYPYTFGGGTKLEIKRTSGGGGSEVQLVESGGGLVQPGGSLKLSC AASGFTFNKYAMNWVRQAPGKGLEWVARIRSKYNNYATYYADSVKDRFTISRDDS KNTAYLQMNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGG TKLTVLHHHHHH |

BAYER II SEQUENCES

| SEQ ID NO | Epitope | Designation | Format/Source | Type | Sequence |
|---|---|---|---|---|---|
| 259 | D2C | CDH3-22 | VH CDR1 | aa | SYPIN |
| 260 | | | VH CDR2 | aa | VIWTGGGTNYNSALKS |
| 261 | | | VH CDR3 | aa | SRGVYDFDGRGAMDY |
| 262 | | | VL CDR1 | aa | KSSQSLLYSSNQKNYLA |
| 263 | | | VL CDR2 | aa | WASTRES |
| 264 | | | VL CDR3 | aa | QQYYSYPYT |
| 265 | | | VH | aa | EVQLLEESGPGLVAPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSS |
| 266 | | | VL | aa | ELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK |
| 267 | | | scFv | aa | EVQLLEESGPGLVAPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK |
| 268 | | | bispecific molecule | aa | EVQLLEESGPGLVAPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 269 | D2C | CDH3-23 | VH CDR1 | aa | SYPIN |
| 270 | | | VH CDR2 | aa | VIWTGGGTNYDSALKS |
| 271 | | | VH CDR3 | aa | SRGAYDFDGRGAMDY |
| 272 | | | VL CDR1 | aa | KSSQSLLYSSNQKNYLA |
| 273 | | | VL CDR2 | aa | WASTRES |
| 274 | | | VL CDR3 | aa | QQYYSYPYT |
| 275 | | | VH | aa | EVQLVEESGPGLVAPSQSLSITCTVSGFSLTSYPINWVRQPPGKGLEWLGVIWTGGGTNYDSALKSRLTISKDNSKSQVFLKMNSLQTDDTARYYCARSRGAYDFDGRGAMDYWGQGTTVTVSS |
| 276 | | | VL | aa | ELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK |
| 277 | | | scFv | aa | EVQLVEESGPGLVAPSQSLSITCTVSGFSLTSYPINWVRQPPGKGLEWLGVIWTGGGTNYDSALKSRLTISKDNSKSQVFLKMNSLQTDDTARYYCARSRGAYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK |

| SEQ ID NO | Epitope | Designation | Format/ Source | Type | Sequence |
|---|---|---|---|---|---|
| 278 | | | bispecific molecule | aa | EVQLVEESGPGLVAPSQSLSITCTVSGFSLTSYPINWVRQPPGKGLEWLGVIWTGGGT NYDSALKSRLTISKDNSKSQVFLKMNSLQTDDTARYYCARSRGAYDFDGRGAMDY WGQGTTVTVSSGGGGSGGGGSGGGGSELVMTQSPSSLAVSVGEKVTMSCKSSQSLL YSSNQKNYLAWYQQKPGQSPKLLIYWASTRESGVPDRFTGSGSGTDFTLTISSVKAE DLAVYYCQQYYSYPYTFGGGTKLEIKRTSGGGGSEVQLVESGGGLVQPGGSLKLSC AASGFTFNKYAMNWVRQAPGKGLEWVARIRSKYNNYATYYADSVKDRFTISRDDS KNTAYLQMNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGG TKLTVLHHHHHH |
| 279 | D3A | CDH3-24 | VH CDR1 | aa | SYWMH |
| 280 | | | VH CDR2 | aa | VIDTSDSYTIYNQKFQG |
| 281 | | | VH CDR3 | aa | SGPGYFDV |
| 282 | | | VL CDR1 | aa | RASGNIHNYLA |
| 283 | | | VL CDR2 | aa | NAKTLAD |
| 284 | | | VL CDR3 | aa | QHFWSTPYT |
| 285 | | | VH | aa | QVQLVQSGAEVKKPGASVKVSCKASGYIFTSYWMHWVRQAPGQGLEWMGVIDTS DSYTIYNQKFQGRVTMTRDTSTSTAYMELSSLRSEDTAVYYCARSGPGYFDVWGQG TMVTVSS |
| 286 | | | VL | aa | DIQLTQSPSFLSASVGDRVTITCRASGNIHNYLAWYQQKPGKAPKLLIYNAKTLADG VPSRFSGSGSGTEFTLKISSLQPEDFATYYCQHFWSTPYTFGQGTKLEIK |
| 287 | | | scFv | aa | QVQLVQSGAEVKKPGASVKVSCKASGYTFTSYWMHWVRQAPGQGLEWMGVIDTS DSYTIYNQKFQGRVTMTRDTSTSTAYMELSSLRSEDTAVYYCARSGPGYFDVWGQG TMVTVSSGGGGSGGGGSGGGGSDIQLTQSPSFLSASVGDRVTITCRASGNIHNYLAW YQQKPGKAPKLLIYNAKTLADGVPSRFSGSGSGTEFTLKISSLQPEDFATYYCQHFWS TPYTFGQGTKLEIK |
| 288 | | | bispecific molecule | aa | QVQLVQSGAEVKKPGASVKVSCKASGYTFTSYWMHWVRQAPGQGLEWMGVIDTS DSYTIYNQKFQGRVTMTRDTSTSTAYMELSSLRSEDTAVYYCARSGPGYFDVWGQG TMVTVSSGGGGSGGGGSGGGGSDIQLTQSPSFLSASVGDRVTITCRASGNIHNYLAW YQQKPGKAPKLLIYNAKTLADGVPSRFSGSGSGTEFTLKISSLQPEDFATYYCQHFWS TPYTFGQGTKLEIKSGGGGSEVQLVESGGGLVQPGGSLRLSCAASGFTFNSYAMNWV RQAPGKGLEWVARIRSKYNNYATYYADSVKGRFTISRDDSKNTAYLQMNSLKTEDT AVYYCVRHGNFGNSYVSWWAYWGQGTLVTVSSGGGGSGGGGSGGGGSQTVVTQE PSLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVL |
| 289 | D3A | CDH3-25 | VH CDR1 | aa | SYWMH |
| 290 | | | VH CDR2 | aa | VIDTSDSYTIYNQKFKG |
| 291 | | | VH CDR3 | aa | SGPGYFDV |
| 292 | | | VL CDR1 | aa | RASENIYSYLA |
| 293 | | | VL CDR2 | aa | NAKTLAE |
| 294 | | | VL CDR3 | aa | QHHYGTPYT |

| SEQ ID NO | Epitope | Designation | Format/Source | Type | Sequence |
|---|---|---|---|---|---|
| 295 | | | VH | aa | QVQLVQSGAEVKKPGASVKVSCKASGYTFTSYWMHWVRQAPGQGLEWMGVIDTS DSYTIYNQKFKGRVTMTRDTSTSTVYMELSSLRSEDTAVYYCARSGPGYFDVWGQG TMVTVSS |
| 296 | | | VL | aa | DIQLTQSPSFLSASVGDRVTITCRASENIYSYLAWYQQKPGKAPKLLIYNAKTLAEGV PSRFSGSGSGTEFTLTISSLQPEDFATYYCQHHYGTPYTFGQGTKLEIK |
| 297 | | | scFv | aa | QVQLVQSGAEVKKPGASVKVSCKASGYTFTSYWMHWVRQAPGQGLEWMGVIDTS DSYTIYNQKFKGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLIYNAKTLAEGVPSRFSGSGSGTEFTLTISSLQPEDFATYYCQHHYG TPYTFGQGTKLEIK |
| 298 | | | bispecific molecule | aa | QVQLVQSGAEVKKPGASVKVSCKASGYTFTSYWMHWVRQAPGQGLEWMGVIDTS DSYTIYNQKFKGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLIYNAKTLAEGVPSRFSGSGSGTEFTLTISSLQPEDFATYYCQHHYG TPYTFGQGTKLEIKSGGGGSEVQLVESGGGLVQPGGSLRLSCAASGFTFNSYAMNWV RQAPGKGLEWVARIRSKYNNYATYYADSVKGRFTISRDDSKNTAYLQMNSLKTEDT AVYYCVRHGNFGNSYYSWWAYWGQGTLVTVSSGGGGSGGGGSGGGGSQTVVTQE PSLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVL |
| 299 | D3A | CDH3-26 | VH CDR1 | aa | SYWMH |
| 300 | | | VH CDR2 | aa | VIDTSDSYTIYNQKFQG |
| 301 | | | VH CDR3 | aa | SGPGYFDV |
| 302 | | | VL CDR1 | aa | RASENIYSYLA |
| 303 | | | VL CDR2 | aa | NAKTLAE |
| 304 | | | VL CDR3 | aa | QHHYGTPYT |
| 305 | | | VH | aa | QVQLVQSGAEVKKPGASVKVSCKASGYTFTSYWMHWVRQAPGQGLEWMGVIDTS DSYTIYNQKFQGRVTMTRDTSTSTVYMELSSLRSEDTAVYYCARSGPGYFDVWGQG TMVTVSS |
| 306 | | | VL | aa | DIQLTQSPSFLSASVGDRVTITCRASENIYSYLAWYQQKPGKAPKLLVYNAKTLAEG VPSRFSGSGSGTEFTLTISSLQPEDFATYYCQHHYGTPYTFGQGTKLEIK |
| 307 | | | scFv | aa | QVQLVQSGAEVKKPGASVKVSCKASGYTFTSYWMHWVRQAPGQGLEWMGVIDTS DSYTIYNQKFQGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLVYNAKTLAEGVPSRFSGSGSGTEFTLTISSLQPEDFATYYCQHHY GTPYTFGQGTKLEIK |
| 308 | | | bispecific molecule | aa | QVQLVQSGAEVKKPGASVKVSCKASGYTFTSYWMHWVRQAPGQGLEWMGVIDTS DSYTIYNQKFQGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLVYNAKTLAEGVPSRFSGSGSGTEFTLTISSLQPEDFATYYCQHHY GTPYTFGQGTKLEIKSGGGGSEVQLVESGGGLVQPGGSLRLSCAASGFTFNSYAMNW VRQAPGKGLEWVARIRSKYNNYATYYADSVKGRFTISRDDSKNTAYLQMNSLKTED TAVYYCVRHGNFGNSYSWWAYWGQGTLVTVSSGGGGSGGGGSGGGGSQTVVTQ EPSLTVSPGGTVTLTCGSSTGAVTSGNYPNWVQQKPGQAPRGLIGGTKFLAPGTPAR FSGSLLGGKAALTLSGVQPEDEAEYYCVLWYSNRWVFGGGTKLTVL |
| 309 | D3A | CDH3-27 | VH CDR1 | aa | SYWMH |
| 310 | | | VH CDR2 | aa | VIDTSDSYTIYAQKFQG |
| 311 | | | VH CDR3 | aa | SGPGYFDV |

BAYER II SEQUENCES

| SEQ ID NO | Epitope | Designation | Format/Source | Type | Sequence |
|---|---|---|---|---|---|
| 312 | | | VL CDR1 | aa | RASENIYSYLA |
| 313 | | | VL CDR2 | aa | NAKTLAE |
| 314 | | | VL CDR3 | aa | QHHYGTPYT |
| 315 | | | VH | aa | QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSS |
| 316 | | | VL | aa | DIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIK |
| 317 | | | scFv | aa | QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIK |
| 318 | | | bispecific molecule | aa | QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIKSGGGGSEVQLVESGGGLVQPGGSLRLSCAASGFTFNSYAMNNYVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 319 | D3A | CDH3-28 | VH CDR1 | aa | SYWMH |
| 320 | | | VH CDR2 | aa | VIDTSDSYTIYNQKVKG |
| 321 | | | VH CDR3 | aa | SGPGYFDV |
| 322 | | | VL CDR1 | aa | RASGNIHNYLA |
| 323 | | | VL CDR2 | aa | NAKTLAD |
| 324 | | | VL CDR3 | aa | QHSWSTPYT |
| 325 | | | VH | aa | EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSS |
| 326 | | | VL | aa | DIQLTQSPSFLSASVGDRVTITCRASGNIHNYLAWYQQKGKAPKLLIYNAKTLADGVPSRFSGSGSGTEFTLTISSLQPEDFATYYCQHSWSTPYTFGQGTKLEIK |
| 327 | | | scFv | aa | EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKGKAPKLLIYNAKTLADGVPSRFSGSGSGTEFTLTISSLQPEDFATYYCQHSWSTPYTFGQGTKLEIK |
| 328 | | | bispecific molecule | aa | EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKGKAPKLLIYNAKTLADGVPSRFSGSGSGTEFTLTISSLQPEDFATYYCQHSWSTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNSLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |

BAYER II SEQUENCES

| SEQ ID NO | Epitope | Designation | Format/Source | Type | Sequence |
|---|---|---|---|---|---|
| 329 | D3A | CDH3-29 | VH CDR1 | aa | SYWMH |
| 330 | | | VH CDR2 | aa | VIDTSDSYTIYNQKVKG |
| 331 | | | VH CDR3 | aa | SGPGYFDV |
| 332 | | | VL CDR1 | aa | RASGNIHNYLA |
| 333 | | | VL CDR2 | aa | NAKTLAD |
| 334 | | | VL CDR3 | aa | QHSWSTPYT |
| 335 | | | VH | aa | EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSS |
| 336 | | | VL | aa | DIQLTQSPSFLSASVGDRVTITCRASGNIHNYLAWYQQKPGKAPKLLIYNAKTLADGVPSRFSGSGSGTEFTLTISSLQPEDFATYYCQHSWSTPYTFGQGTKLEIK |
| 337 | | | scFv | aa | EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLTISSLQPEDFATYYCQHSWSTPYTFGQGTKLEIK |
| 338 | | | bispecific molecule | aa | EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLTISSLQPEDFATYYCQHSWSTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLVVYSNRWVFGGGTKLTVL |
| 339 | D3A | CDH3-30 | VH CDR1 | aa | SYWMH |
| 340 | | | VH CDR2 | aa | VIDTSDSYTIYNQKVKG |
| 341 | | | VH CDR3 | aa | SGPGYFDV |
| 342 | | | VL CDR1 | aa | RASENIYSYLA |
| 343 | | | VL CDR2 | aa | NAKTLAE |
| 344 | | | VL CDR3 | aa | QHHYGTPYT |
| 345 | | | VH | aa | EVQLLESGGGLVQPGGSLRLSCAASGYTFSSYWMHWVRQAPGKGLEWMGVIDTSDSYTIYNQKVKGRFTISRDNSKNTVYLQMNSLRAGDTAVYYCARSGPGYFDVWGQGTMVTVSS |
| 346 | | | VL | aa | DIQLTQSPSFLSASVGDRVTITCRASENIYSYLAWYQQKPGKAPKLLIYNAKTLAEGVPSRFSGSGSGTEFTLTISSLQPEDFGTYYCQHHYGTPYTFGQGTKLEIK |
| 347 | | | scFv | aa | EVQLLESGGGLVQPGGSLRLSCAASGYTFSSYWMHWVRQAPGKGLEWMGVIDTSDSYTIYNQKVKGRFTISRDNSKNTVYLQMNSLRAGDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFGTYYCQHHYGTPYTFGQGTKLEIK |

BAYER II SEQUENCES

| SEQ ID NO | Epitope | Designation | Format/Source | Type | Sequence |
|---|---|---|---|---|---|
| 348 | | | bispecific molecule | aa | EVQLLESGGGLVQPGGSLRLSCAASGYTFSSYWMHWVRQAPGKGLEWMGVIDTSD SYTIYNQKVKGRFTISRDNSKNTVYLQMNSLRAGDTAVYYCARSGPGYFDVWGQGT MVTVSSGGGGSGGGGSGGGGSDIQLTQSPSFLSASVGDRVTITCRASENIYSYLAWY QQKPGKAPKLLIYNAKTLAEGVPSRFSGSGSGTEFTLTISSLQPEDFGTYYCQHHYGT PYTFGQGTKLEIKSGGGGSEVQLVESGGGLVQPGGSLKLSCAASGFTFNKYAMNWV RQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEP SLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVL |
| 349 | D3A | CDH3-31 | VH CDR1 | aa | SYWMH |
| 350 | | | VH CDR2 | aa | VIDTSDSYTIYNQKVKG |
| 351 | | | VH CDR3 | aa | SGPGYFDV |
| 352 | | | VL CDR1 | aa | RASENIYSYLA |
| 353 | | | VL CDR2 | aa | NAKTLAE |
| 354 | | | VL CDR3 | aa | QHHYGTPYT |
| 355 | | | VH | aa | EVQLLESGGGLVQPGGSLRLSCAASGYTFSSYWMHWVRQAPGKGLEWVGVIDTSDS YTIYNQKVKGRFTISRDTSKNTVYLQLNSLRAEDTAVYYCAKSGPGYFDVWGQGTM VTVSS |
| 356 | | | VL | aa | DIQLTQSPSFLSASVGDRVTITCRASENIYSYLAWYQQKPGKAPKLLIYNAKTLAEGV PSRFSGSGSGTEFTLTISSLQPEDFASYYCQHHYGTPYTFGQGTKLEIK |
| 357 | | | scFv | aa | EVQLLESGGGLVQPGGSLRLSCAASGYTFSSYWMHWVRQAPGKGLEWVGVIDTSDS YTIYNQKVKGRFTISRDTSKNTVYLQLNSLRAEDTAVYYCAKSGPGYFDVWGQGTM VTVSSGGGGSGGGGSGGGGSDIQLTQSPSFLSASVGDRVTITCRASENIYSYLAWYQQ KPGKAPKLLIYNAKTLAEGVPSRFSGSGSGTEFTLTISSLQPEDFASYYCQHHYGTPYT FGQGTKLEIK |
| 358 | | | bispecific molecule | aa | EVQLLESGGGLVQPGGSLRLSCAASGYTFSSYWMHWVRQAPGKGLEWVGVIDTSDS YTIYNQKVKGRFTISRDTSKNTVYLQLNSLRAEDTAVYYCAKSGPGYFDVWGQGTM VTVSSGGGGSGGGGSGGGGSDIQLTQSPSFLSASVGDRVTITCRASENTYSYLAWYQQ KPGKAPKLLIYNAKTLAEGVPSRFSGSGSGTEFTLTISSLQPEDFASYYCQHHYGTPYT FGQGTKLEIKSGGGGSEVQLVESGGGLVQPGGSLKLSCAASGFTFNKYAMNWVRQA PGKGLEWVARIRSKYNNYATYYADSVKDRFTISRDDSKNTAYLQMNNLKTEDTAVY YCVRHGNFGNSYISYWAYWGQGTLVTVSSGGGGSGGGGSGGGGSQTVVTQEPSLT VSPGGTVTLTCGSSTGAVTSGNYPNWVQQKPGQAPRGLIGGTKFLAPGTPARFSGSL LGGKAALTLSGVQPEDEAEYYCVLWYSNRWVFGGGTKLTVL |
| 359 | D3A | CDH3-32 | VH CDR1 | aa | SYWMH |
| 360 | | | VH CDR2 | aa | VIDTSDSYTIYNQKFKG |
| 361 | | | VH CDR3 | aa | SGPGYFDV |
| 362 | | | VL CDR1 | aa | RASENIYSYLA |
| 363 | | | VL CDR2 | aa | NAKTLAE |
| 364 | | | VL CDR3 | aa | QHHYGTPYT |
| 365 | | | VH | aa | EVQLVEQPGAELVRPGTSVKLSCKASGYTFTSYWMHWVKQRPGQGLEWIGVIDTSD SYTIYNQKFKGKATLTVDTSSSTAYMQLSSLTSEDSSVYFCARSGPGYFDVWGQGTT VTVSS |

| SEQ ID NO | Epitope | Designation | Format/ Source | Type | Sequence |
|---|---|---|---|---|---|
| 366 | | | VL | aa | ELQMTQSPASLSASVGETVTITCRASENIYSYLAWYQQKQGKSPQLLVYNAKTLAEG VPSRFSGSGSGTQFSLKINSLQPEDFGSYYCQHHYGTPYTFGGGTKLEIK |
| 367 | | | scFv | aa | EVQLVEQPGAELVRPGTSVKLSCKASGYTFTSYWMHWVKQRPGQGLEWIGVIDTSD SYTIYNQKFKGKATLTVDTSSSTAYMQLSSLTSEDSSVYFCARSGPGYFDVWGQGTT VTVSSGGGGSGGGGSGGGGSELQMTQSPASLSASVGETVTITCRASENIYSYLAWYQ QKQGKSPQLLVYNAKTLAEGVPSRFSGSGSGTQFSLKINSLQPEDFGSYYCQHHYGT PYTFGGGTKLEIK |
| 368 | | | bispecific molecule | aa | EVQLVEQPGAELVRPGTSVKLSCKASGYTFTSYWMHWVKQRPGQGLEWIGVIDTSD SYTIYNQKFKGKATLTVDTSSSTAYMQLSSLTSEDSSVYFCARSGPGYFDVWGQGTT VTVSSGGGGSGGGGSGGGGSELQMTQSPASLSASVGETVTITCRASENIYSYLAWYQ QKQGKSPQLLVYNAKTLAEGVPSRFSGSGSGTQFSLKINSLQPEDFGSYYCQHHYGT PYTFGGGTKLEIKRTSGGGGSEVQLVESGGGLVQPGGSLKLSCAASGFTFNKYAMN WVRQAPGKGLEWVARIRSKYNNYATYYADSVKDRFTISRDDSKNTAYLQMNNLKT EDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVLHHHHHH |
| 369 | D3A | CDH3-33 | VH CDR1 | aa | SYWMH |
| 370 | | | VH CDR2 | aa | VIDTSDSYTIYNQKFKG |
| 371 | | | VH CDR3 | aa | SGPGYFDV |
| 372 | | | VL CDR1 | aa | RASGNIHNYLA |
| 373 | | | VL CDR2 | aa | NAKTLAD |
| 374 | | | VL CDR3 | aa | QHFWSTPYT |
| 375 | | | VH | aa | EVQLVEQPGAELVRPGTSVKLSCKASGYTFTSYWMHWVKQRPGQGLEWIGVIDTSD SYTIYNQKFKGKATLTVDTSSSTAYMQLSSLTSGDSSVYFCARSGPGYFDVWGQGTT VTVSS |
| 376 | | | VL | aa | ELVMTQSPASLSASVGETVTITCRASGNIHNYLAWYQQKQGKSPQLLVYNAKTLAD GVPSRFSGSGSGTQYSLKINSLQPEDFGTYYCQHFWSTPYTFGGGTKLEIK |
| 377 | | | scFv | aa | EVQLVEQPGAELVRPGTSVKLSCKASGYTFTSYWMHWVKQRPGQGLEWIGVIDTSD SYTIYNQKFKGKATLTVDTSSSTAYMQLSSLTSGDSSVYFCARSGPGYFDVWGQGTT VTVSSGGGGSGGGGSGGGGSELVMTQSPASLSASVGETVTITCRASGNIHNYLAWYQ QKQGKSPQLLVYNAKTLADGVPSRFSGSGSGTQYSLKINSLQPEDFGTYYCQHFWST PYTFGGGTKLEIK |
| 378 | | | bispecific molecule | aa | EVQLVEQPGAELVRPGTSVKLSCKASGYTFTSYWMHWVKQRPGQGLEWIGVIDTSD SYTIYNQKFKGKATLTVDTSSSTAYMQLSSLTSGDSSVYFCARSGPGYFDVWGQGTT VTVSSGGGGSGGGGSGGGGSELVMTQSPASLSASVGETVTITCRASGNIHNYLAWYQ QKQGKSPQLLVYNAKTLADGVPSRFSGSGSGTQYSLKINSLQPEDFGTYYCQHFWST PYTFGGGTKLEIKRTSGGGGSEVQLVESGGGLVQPGGSLKLSCAASGFTFNKYAMN WVRQAPGKGLEWVARIRSKYNNYATYYADSVKDRFTISRDDSKNTAYLQMNNLKT EDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVLHHHHHH |
| 379 | D2C | CDH3-13 xI2C-HALB | | aa | EVQLLESGGGLVQPGGSLRLSCAASGFSFSSYPINWVRQAPGKGLEWVGVIWTGGGT NYASSVKGRFTISRDNSKNTVYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYFAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGS GGGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFA KTCVADESAENCDKSLHTLFGDKLCTVATLRETYGEMADCCAKQEPERNECFLQHK DDNPNLPRLVRPEVDVMCTAFHDNEETFLKKYLYEIARRHPYFYAPELLFFAKRYKA AFTECCQAADKAACLLPKLDELRDEGKASSAKQRLKCASLQKFGERAFKAWAVARL |

-continued

| BAYER II SEQUENCES | | | | |
|---|---|---|---|---|
| SEQ ID NO | Epitope Designation | Format/ Source | Type | Sequence |
| | | | | SQRFPKAEFAEVSKLVTDLTKVHTECCHGDLLECADDRADLAKYICENQDSISSKLK ECCEKPLLEKSHCIAEVENDEMPADLPSLAADFVESKDVCKNYAEAKDVFLGMFLYE YARRHPDYSVVLLLRLAKTYETTLEKCCAAADPHECYAKVFDEFKPLVEEPQNLIKQ NCELFEQLGEYKFQNALLVRYTKKVPQVSTPTLVEVSRNLGKVGSKCCKHPEAKRM PCAEDYLSWLNQLCVLHEKTPVSDRVTKCCTESLVNRRPCFSALEVDETYVPKEFN AETFTFHADICTLSEKERQIKKQTALVELVKHKPKATKEQLKAVMDDFAAFVEKCCK ADDKETCFAEEGKKLVAASQAALGL |
| 380 | D2C | CDH3-13 xI2C-HALB-variant-1 | aa | EVQLLESGGGLVQPGGSLRLSCAASGFSFSSYPINWVRQAPGKGLEWVGVIWTGGGT NYASSVKGRFTISRDNSKNTVYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYFAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFA KTCVADESAENCDKSLHTLFGDKLCTVATLRETYGEMADCCAKQEPERNECFLQHK DDNPNLPRLVRPEVDVMCTAFHDNEETFLKKYLYEIARRHPYFYAPELLFFAKRYKA AFTECCQAADKAACLLPKLDELRDEGKASSAKQRLKCASLQKFGERAFKAWAVARL SQRFPKAEFAEVSKLVTDLTKVHTECCHGDLLECADDRADLAKYICENQDSISSKLK ECCEKPLLEKSHCIAEVENDEMPADLPSLAADFVESKDVCKNYAEAKDVFLGMFLYE YARRHPDYSVVLLLRLAKTYETTLEKCCAAADPHECYAKVFDEFKPLVEEPQNLIKQ NCELFEQLGEYKFQNALLVRYTKKVPQVSTPTLVEVSRNLGKVGSKCCKHPEAKRM PCAEDYLSVVLNQLCVLHEKTPVSDRVTKCCTESLVNRRPCFSALEVDETYVPKEFN AGTFTFHADICTLSEKERQIKKQTALVELVKHKPKATKEQLKAAMDDFAAFVEKCC KADDKETCFAEEGKKLVAASQAALGL |
| 381 | D2C | CDH3-13 xI2C-LY-FcB-CH | aa | QRFVTGHFGGLYPANGGGGGSEVQLLESGGGLVQPGGSLRLSCAASGFSFSSYPINW VRQAPGKGLEWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNIRINSYISYWA YWGQGTLVTVSSGGGGSGGGGSGGGGSQTVVTQEPSLTVSPGGTVTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFCTGHFGGLHPCNGP |
| 382 | D2C | CDH3-13 xI2C-LH-FcB-CH | aa | QRFVTGHFGGLHPANGGGGGSEVQLLESGGGLVQPGGSLRLSCAASGFSFSSYPINW VRQAPGKGLEWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWA YWGQGTINTVSSGGGGSGGGGSGGGGSQTVVTQEPSLTVSPGGINTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFCTGHFGGLHPCNGP |
| 383 | D2C | CDH3-13 xI2C-LH-FcB-LH | aa | QRFVTGHFGGLHPANGGGGGSEVQLLESGGGLVQPGGSLRLSCAASGFSFSSYPINW VRQAPGKGLEWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWA YWGQGTLVTVSSGGGGSGGGGSGGGGSQTVVTQEPSLTVSPGGTVTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFVTGHFGGLHPANGP |
| 384 | D2C | CDH3-13 xI2C-LY-FcB-LH | aa | QRFVTGHFGGLYPANGGGGGSEVQLLESGGGLVQPGGSLRLSCAASGFSFSSYPINW VRQAPGKGLEWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWA YWGQGTLVTVSSGGGGSGGGGSGGGGSQTVVTQEPSLTVSPGGTVTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFVTGHFGGLHPANGP |

-continued

| | | BAYER II SEQUENCES | | |
|---|---|---|---|---|
| SEQ ID NO | Epitope Designation | Format/ Source | Type | Sequence |
| 385 | D2C CDH3-13 xI2C-CH-FcB-LH | | aa | QRFCTGHFGGLHPCNGGGGGSEVQLLESGGGLVQPGGSLRLSCAASGFSFSSYPINW VRQAPGKGLEWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWA YWGQGTLVTVSSGGGGSGGGGSGGGGSQTVVTQEPSLTVSPGGTVTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFVTGHFGGLEPANGP |
| 386 | D2C CDH3-13 xI2C-CH-FcB-LY | | aa | QRFCTGHFGGLHPCNGGGGGSEVQLLESGGGLVQPGGSLRLSCAASGFSFSSYPINW VRQAPGKGLEWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVIRQAPGKGLEWVARIRSKYNNY ATYYADSVKDRFTISRDDSKNTAYLQMNNLKTEDTAVYYCVRHGNRINSYISYWA YWGQGTLVTVSSGGGGSGGGGSGGGGSQTVVTQEPSLTVSPGGTVTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFVTGHFGGLYPANGP |
| 387 | D2C CDH3-13 xI2C-156 | | aa | EVQLLESGGGLVQPGGSLRLSCAASGFSFSSYPINWVRQAPGKGLEWVGVIWTGGGT NYASSVKGRFTISRDNSKNTVYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYFAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKESCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL GGGGSGGGSRDWDFDVFGGGTPVGGP |
| 388 | D2C CDH3-13 xI2C-LY-FcB-CH-156 | | aa | QRFVTGHFGGLYPANGGGGGSEVQLLESGGGLVQPGGSLRLSCAASGFSFSSYPINW VRQAPGKGLEWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWA YWGQGTLVTVSSGGGGSGGGGSGGGGSQTVVTQEPSLTVSPGGTVTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFCTGHRIGLHPCNGGGGGSGGGSRD WDFDVFGGGTPVGGP |
| 389 | D2C CDH3-13 xI2C-CH-FcB-LY-156 | | aa | QRFCTGHFGGLHPCNGGGGGSEVQLLESGGGLVQPGGSLRLSCAASGFSFSSYPINW VRQAPGKGLWVGVIWTGGGTNYASSVKGRFTISRDNSKNTVYLQMNSLRAEDTA VYYCAKSRGVYDFDGRGAMDYWGQGTLVTVSSGGGGSGGGGSGGGGSDIVMTQS PDSLAVSLGERATINCKSSQSLLYSSNQKNYFAWYQQKPGQPPKLLIYWASTRESGV PDRFSGSGSGTDFTLTISSLQAEDVAVYYCQQYYSYPYTFGQGTKLEIKSGGGGSEVQ LVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWA YWGQGTLYTVSSGGGGSGGGGSGGGGSQTVVTQEPSLTVSPGGTVTLTCGSSTGAV TSGNYPNWVQQKPGQAPRGLIGGTKFLAPGTPARFSGSLLGGKAALTLSGVQPEDEA EYYCVLWYSNRWVFGGGTKLTVLGGGGSQRFVTGHFGGLYPANGGGGGSGGGSRD WDFDVFGGGTPVGGP |
| 390 | Human epitope cluster D3C | human | aa | HTLYVEVTNEAPFVLKLPTSTATIVVHVEDVNEAPVF |
| 391 | Macaque epitope cluster D3C | cynomolgus | aa | HTLYVEVTNEAPFVLKLPTSTATIVVHVEDVNEAPVF |
| 392 | linker 1 | artificial | aa | GGGG |
| 393 | linker 2 | artificial | aa | GGGGS |
| 394 | linker 3 | artificial | aa | GGGGQ |

-continued

| BAYER II SEQUENCES | | | | | |
|---|---|---|---|---|---|
| SEQ ID NO | Epitope | Designation | Format/ Source | Type | Sequence |
| 395 | | linker 4 | artificial | aa | SGGGGS |
| 396 | | linker 5 | artificial | aa | PGGGGS |
| 397 | | linker 6 | artificial | aa | PGGDGS |
| 398 | | linker 7 | artificial | aa | GGGGSGGGS |
| 399 | | linker 8 | artificial | aa | GGGGSGGGGS |
| 400 | | linker 9 | artificial | aa | GGGGSGGGGSGGGGS |
| 401 | | linker 10 (G$_4$S)$_4$ | artificial | aa | GGGGSGGGGSGGGGSGGGGS |
| 402 | | linker 11 (G$_4$S)$_5$ | artificial | aa | GGGGSGGGGSGGGGSGGGGSGGGGS |
| 403 | | linker 12 (G$_4$S)$_6$ | artificial | aa | GGGGSGGGGSGGGGSGGGGSGGGGSGGGGS |
| 404 | | linker 13 (G$_4$S)$_7$ | artificial | aa | GGGGSGGGGSGGGGSGGGGSGGGGSGGGGSGGGGS |
| 405 | | linker 14 (G$_4$S)$_8$ | artificial | aa | GGGGSGGGGSGGGGSGGGGSGGGGSGGGGSGGGGSGGGGS |
| 406 | | Fc monomer-1 +c/-g | artificial | aa | DKTHTCPPCPAPELLGGPSVFLFPPKPKDTLMISRTPEVTCVVVDVSHEDPEVKFNWY VDGVEVHNAKTKPCEEQYGSTYRCVSVLTVLEQDWLNGKEYKCKVSNKALPAPIEK TISKAKGQPREPQVYTLPPSREEMTKNQVSLTCLVKGIFYPSDIAVEWESNGQPENNY KTTPPVLDSDGSFFLYSKLTVDKSRWQQGNVFSCSVMHEALHNHYTQKSLSLSPGK |
| 407 | | Fc monomer-2 +c/-g/ delGK | artificial | aa | DKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSP |
| 408 | | Fc monomer-3 -c/+g | artificial | aa | DKTHTCPPCPAPELLGGPSVFLFPPKPKDTLMISRTPEVTCVVVDVSHEDPEVKFNWY VDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK |
| 409 | | Fc monomer-4 -c/+g/ delGK | artificial | aa | DKTHTCPPCPAPELLGGPSVFLFPPKPKDTLMISRTPEVTCVVVDVSHEDPEVKFNWY VDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSICLTVDKSRWQQGNVFSCSVMHEALHNHYTQKSLSLSP |
| 410 | | Fc monomer-5 -c/-g | artificial | aa | DKTHTCPPCPAPELLGGPSVFLFPPKPKDTLMISRTPEVTCVVVDVSHEDPEVKFNWY VDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK |
| 411 | | Fc monomer-6 -c/-g/ delGK | artificial | aa | DKTHTCPPCPAPELLGGPSVFLFPPKPKDTLMISRTPEVTCVVVDVSHEDPEVKFNWY VDGVEVHNAKTKPREEQYGSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSP |
| 412 | | Fc monomer-7 +c/+g | artificial | aa | DKTHTCPPCPAPELLGGPSVFLFPPKPKDTLMISRTPEVTCVVVDVSHEDPEVKFNWY VDGVEVHNAKTKPCEEQYNSTYRCVSVLTVLHQDWLNGKEYKCKVSNKALPAPIEK TISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK |
| 413 | | Fc monomer-8 +c/+g/ delGK | artificial | aa | DKTHTCPPCPAPELLGGPSVFLFPPKPKDTLMISRTPEVTCVVVDVSHEDPEVKFNWY VDGVEVHNAKTKPCIEQYNSTYRCVSVLTVLHQDWLNGKEYKCKVSNKALPAPIEK TISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSP |
| 414 | | scFc-1 | artificial | aa | DKTHTCPPCPAPELLGGPSVFLFPPKPKDTLMISRTPEVTCVVVDVSHEDPEVKFNWY VDGVEVFINAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGKG GGGSGGGGSGGGGSGGGGSGGGGSGGGGSDKTHTCPPCPAPELLGGPSVFLFPPKPK DTLMISRTPEVTCVVVDVSHEDPEVKFNWYVDGVEVHNAKTKPCEEQYGSTYRCVS |

-continued

| BAYER II SEQUENCES | | | | |
|---|---|---|---|---|
| SEQ ID NO | Epitope | Designation | Format/ Source | Type Sequence |
| | | | | VLTVLHQDWLNGKEYKCKVSNKALPAPIEKTISKAKGQPREPQVYTLPPSREEMTKN QVSLTCLVKGFYPSDIAVEWESNGQPENNYKTTPPVLDSDGSFFLYSKLTVDKSRWQ QGNVFSCSVMHEALHNHYTQKSLSLSPGK |
| 415 | | scFc-2 | artificial | aa DKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGGG GSGGGGSGGGGSGGGGSGGGGSGGGGSDKTHTCPPCPAPELLGGPSVFLFPPKPKDT LMISRTPEVTCVVVDVSHEDPEVKFNWYVDGVEVHNAKTKPCEEQYGSTYRCVSVL TVLHQPWLNGKEYKCKVSNKALPAPIEKTISKAKGQPREPQVYTLPPSREEMTKNQV SLTCLVKGFYPSDIAVEWESNGQPENNYKTTPPVLDSDGSFFLYSKLTVDKSRWQQG NVFSCSVMHEALHNHYTQKSLSLSP |
| 416 | | scFc-3 | artificial | aa DKTHTCPPCPAPELLGGPSVFLFPPKPKDTLMISRTPEVTCVVVDVSHEDPEVKFNWY VDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK GGGGSGGGGSGGGGSGGGGSGGGGSGGGGSDKTHTCPPCPAPELLGGPSVFLFPPKP KDTLMISRTPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPPSREEMTK NQVSLTCLVKGFYPSDIAVEWESNGQPENNYKTTPPVLDSDGSFFLYSKLTVDKSRW QQGNVFSCSVMHEALHNHYTQKSLSLSPGK |
| 417 | | scFc-4 | artificial | aa DKTHTCPPCPAPELLGGPSVFLFPPKPKDTLMISRTPEVTCVVVDVSHEDPEVKFNWY VDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGG GGSGGGGSGGGGSGGGGSGGGGSGGGGSDKTHTCPPCPAPELLGGPSVFLFPPKPKD TLMISRTPEVTCVVVDVSHEDPEVKFNWYVDGVEVHNAKTKPREEQYNSTYRVVSV LTVLHQDWLNGKEYKCKVSNKALPAPIEKTISKAKGQPREPQVYTLPPSREEMTKNQ VSLTCLVKGFYPSDIAVEWESNGQPENNYKTTPPVLDSDGSFFLYSKLTVDKSRWQQ GNVFSCSVMHEALHNHYTQKSLSLSP |
| 418 | | scFc-5 | artificial | aa DKTHTCPPCPAPELLGGPSVFLFPPKPKDTLMISRTPEVTCVVVDVSHEDPEVKFNWY VDGVEVHNAKTKPREEQYGSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK GGGGSGGGGSGGGGSGGGGSGGGGSGGGGSDKTHTCPPCPAPELLGGPSVFLFPPKP KDTLMISRTPEVTCVVVDVSHEDPEVKFNWYVDGVEVHNAKTKPREEQYGSTYRVV SVLTVLHQDWLNGKEYKCKVSNKALPAPIEKTISKAKGQPREPQVYTLPPSREEMTK NQVSLTCLVKGFYPSDIAVEWESNGQPENNYKTTPPVLDSDGSFFLYSKLTVDKSRW QQGNVFSCSVMHEALHNHYTQKSLSLSPGK |
| 419 | | scFc-6 | artificial | aa DKTHTCPPCPAPELLGGPSVFLFPPKPKDTLMISRTPEVTCVVVDVSHEDPEVKFNWY VDGVEVHNAKTKPREEQYGSTYRVVSVLTVLHQDWLNGKEYKCKVSNKALPAPIE KTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGG GGSGGGGSGGGGSGGGGSGGGGSGGGGSDKTHTCPPCPAPELLGGPSVFLFPPKPKD TLMISRTPEVTCVVVDVSHEDPEVKFNWYVDGVEVHNAKTKPREEQYGSTYRVVSV LTVLHQDWLNGKEYKCKVSNKALPAPIEKTISKAKGQPREPQVYTLPPSREEMTKNQ VSLTCLVKGFYPSDIAVEWESNGQPENNYKTTPPVLDSDGSFFLYSKLTVDKSRWQQ GNVFSCSVMHEALHNHYTQKSLSLSP |
| 420 | | scFc-7 | artificial | aa DKTHTCPPCPAPELLGGPSVFLFPPKPKDTLMISRTPEVTCVVVDVSHEDPEVKFNWY VDGVEVHNAKTKPCEEQYNSTYRCVSVLTVLHQDWLNGKEYKCKVSNKALPAPIEK TISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGKG GGGSGGGGSGGGGSGGGGSGGGGSGGGGSDKTHTCPPCPAPELLGGPSVFLFPPKPK DTLMISRTPEVTCVVVDVSHEDPEVKFNWYVDGVEVHNAKTKPCEEQYNSTYRCVS VLTVLHQDWLNGKEYKCKVSNKALPAPIEKTISKAKGQPREPQVYTLPPSREEMTKN QVSLTCLVKGFYPSDIAVEWESNGQPENNYKTTPPVLDSDGSFFLYSKLTVDKSRWQ QGNVFSCSVMHEALHNHYTQKSLSLSPGK |
| 421 | | scFc-8 | artificial | aa DKTHTCPPCPAPELLGGPSVFLFPPKPKDTLMISRTPEVTCVVVDVSHEDPEVKFNWY VDGVEVHNAKTKPCEEQYNSTYRCVSVLTVLHQDWLNGKEYKCKVSNKALPAPIEK TISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGGG GSGGGGSGGGGSGGGGSGGGGSGGGGSDKTHTCPPCPAPELLGGPSVFLFPPKPKDT LMISRTPEVTCVVVDVSHEDPEVKFNWYVDGVEVHNAKTKPCEEQYNSTYRCVSVL TVLHQDWLNGKEYKCKVSNKALPAPIEKTISKAKGQPREPQVYTLPPSREEMTKNQV SLTCLVKGFYPSDIAVEWESNGQPENNYKTTPPVLDSDGSFFLYSKLTVDKSRWQQG NVFSCSVMHEALHNHYTQKSLSLSP |

-continued

| | | | | |
|---|---|---|---|---|
| BAYER II SEQUENCES | | | | |
| SEQ ID NO | Epitope Designation | Format/ Source | Type | Sequence |
| 422 | D2C CDH3-11 xI2C-scFc | Bispecific HLE molecule | aa | EVQLLESGGGLVQPGGSLRLSCAVSGFTLSSYPINWVRQAPGKGLEWVSVIWTGGGT NYASSVKGRFTISRDNSKNTLYLQMNSLRAEDTAVYYCAKSRGVYDFDGRGAMDY WGQGTLVTVSSGGGGSGGGGSGGGGSDIVMTQSPDSLAVSVGERVTINCKSSQSLLY SSNQKNYLAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKCKVSNKALP APIEKTISKAKGQPREPQVYTLPPSREEMTKNQVSLTCLVKGFYPSDIAVEWESNGQP ENNYKTTPPVLDSDGSFFLYSKLTVDKSRWQQGNVFSCSVMHEALHNHYTQKSLSL SPGKGGGGSGGGGSGGGGSGGGGSGGGGSGGGGSDKTHTCPPCPAPELLGGPSVFLF PPKPKDTLMISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQVYTLPPSRE EMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 423 | D2C CDH3-12 xF12q-scFc | Bispecific HLE molecule | aa | QVQLQESGPGLVKPSETLSLTCTVSGVSITSYPINWIRQPPGKGLEWIGVIWTGGGTN YNPSLKSRVTISVDTSKNQFSLKLSSVTAADTAVYYCARSRGWDFDGRGAMDYWG QGTLVTVSSGGGGSGGGGSGGGGSDIVMTQSPASLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIKSGGGGSEVQLVESGGGLVQPGGSLKLSCAASGFTF NSYAMNWVRQAPGKGLEWVARIRSKYNNYATYYADSVKGRFTISRDDSKNTAYLQ MNSLKTEDTAVYYCVRHGNFGNSYVSWWAYWGQGTLVTVSSGGGGSGGGGSGGG GSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVLGG GGDKTHTCPPCPAPELLGGPSVFLFPPKPKDTLMISRTPEVTCVVVDVSHEDPEVKFN WYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPEN NYKTTPPVLDSDGSFFLYSKLTVDKSRWQQGNVFSCSVMHEALHNHYTQKSLSLSPG KGGGGSGGGGSGGGGSGGGGSGGGGSGGGGSDKTHTCPPCPAPELLGGPSVFLFPPK PKDTLMISRTPEVTCVVVDVSHEDPEVKFNWYVDGVEVHNAKTKPCEEQYGSTYRC VSVLTVLHQDWLNGKEYKCKVSNKALPAPIEKTISKAKGQPREPQVYTLPPSREEMT KNQVSLTCLVKGFYPSDIAVEWESNGQPENNYKTTPPVLDSDGSFFLYSKLTVDKSR WQQGNVFSCSVMHEALHNHYTQKSLSLSPGK |
| 424 | D2C CDH3-12 xI2C-scFc | Bispecific HLE molecule | aa | QVQLQESGPGLVKPSETLSLTCTVSGVSITSYPINWIRQPPGKGLEWIGVIWTGGGTN YNPSLKSRVTISVDTSKNQFSLKLSSVTAADTAVYYCARSRGWDFDGRGAMDYWG QGTLVTVSSGGGGSGGGGSGGGGSDIVMTQSPASLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIKSGGGGSEVQLVESGGGLVQPGGSLKLSCAASGFTF NKYAMNWVRQAPGKGLEWVARIRSKYNNYATYYADSVKDRFTISRDDSKNTAYLQ MNNLKTEDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVLGG GGDKTHTCPPCPAPELLGGPSVFLFPPKPKDTLMISRTPEVTCVVVDVSHEDPEVKFN WYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPEN NYKTTPPVLDSDGSFFLYSKLTVDKSRWQQGNVFSCSVMHEALHNHYTQKSLSLSPG KGGGGSGGGGSGGGGSGGGGSGGGGSGGGGSDKTHTCPPCPAPELLGGPSVFLFPPK PKDTLMISRTPEVTCVVVDVSHEDPEVKFNWYVDGVEVHNAKTKPCEEQYGSTYRC VSVLTVLHQDWLNGKEYKCKVSNKALPAPIEKTISKAKGQPREPQVYTLPPSREEMT KNQVSLTCLVKGFYPSDIAVEWESNGQPENNYKTTPPVLDSDGSFFLYSKLTVDKSR WQQGNVFSCSVMHEALHNHYTQKSLSLSPGK |
| 425 | D2C CDH3-13 xI2C-scFc | Bispecific HLE molecule | aa | EVQLLESGGGLVQPGGSLRLSCAASGFSFSSYPINWVRQAPGKGLEWVGVIWTGGGT NYASSVKGRFTISRDNSKNTVYLQMNSLRAEDTAVYYCAKSRGVYDFDGRGAMDY WGQGTLVTVSSGGGGSGGGGSGGGGSDIVMTQSPDSLAVSLGERATINCKSSQSLLY SSNQKNYFAWYQQKPGQPPKLLIYWASTRESGVPDRFSGSGSGTDFTLTISSLQAEDV AVYYCQQYYSYPYTFGQGTKLEIKSGGGGSEVQLVESGGGLVQPGGSLKLSCAASGF TFNKYAMNWVRQAPGKGLEWVARIRSKYNNYATYYADSVKDRFTISRDDSKNTAY LQMNNLKTEDTAVYYCVRHGNFGNSYISYWAYWGQGTLVTVSSGGGGSGGGGSG GGSQTVVTQEPSLTVSPGGTVTLTCGSSTGAVTSGNYPNWVQQKPGQAPRGLIGGT KFLAPGTPARFSGSLLGGKAALTLSGVQPEDEAEYYCVLWYSNRWVFGGGTICLTVL GGGGDKTHTCPPCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKCKVSNKALP APIEKTISKAKGQPREPQVYTLPPSREEMTKNQVSLTCLVKGFYPSDIAVEWESNGQP ENNYKTTPPVLDSDGSFFLYSKLTVDKSRWQQGNVFSCSVMHEALHNHYTQKSLSL SPGKGGGGSGGGGSGGGGSGGGGSGGGGSGGGGSDKTHTCPPCPAPELLGGPSVFLF PPKPKDTLMISRTPEVTCVVVDVSHEDPEVKFNWYVDGVEVHNAKTKPCEEQYGST |

-continued

| BAYER II SEQUENCES | | | | |
|---|---|---|---|---|
| SEQ ID NO | Epitope Designation | Format/ Source | Type | Sequence |
| | | | | YRCVSVLTVLHQDWLNGKEYKCKVSNKALPAPIEKTISKAKGQPREPQVYTLPPSRE EMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 426 | D2C | CDH3-14 xF12q- scFc | Bispecific HLE molecule aa | QVQLQESGPGLVKPSETLSLTCTVSGGSITSYPINWIRQPPGKGLEWIGVIWTGGGTN YNPSLKSRVTISVDTSKNQFSLKLSSVTAADTAVYYCARSRGVYDFDGRGAMDYWG QGTLVTVSSGGGGSGGGGSGGGGSDIVMTQSPDSLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIKSGGGGSEVQLVESGGGLVQPGGSLRLSCAASGFTF NSYAMNWVRQAPGKGLEWVARIRSKYNNYATYYADSVKGRFTISRDDSKNTAYLQ MNSLKTEDTAVYYCVRHGNFGNSYVSWWAYWGQGTLVTVSSGGGGSGGGGSGGG GSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVLGG GGDKTHTCPPCPAPELLGGPSVFLFPPKPKDTLMISRTPEVTCVVVDVSHEDPEVKFN WYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPEN NYKTTPPVLDSDGSFFLYSKLTVDKSRWQQGNVFSCSVMHEALHNHYTQKSLSLSPG KGGGGSGGGGSGGGGSGGGGSGGGGSDKTHTCPPCPAPELLGGPSVFLFPPK PKDTLMISRTPEVTCVVVDVSHEDPEVKFNWYVDGVEVHNAKTKPCEEQYGSTYRC VSVLTVLHQDWLNGKEYKCKVSNKALPAPIEKTISKAKGQPREPQVYTLPPSREEMT KNQVSLTCLVKGFYPSDIAVEWESNGQPENNYKTTPPVLDSDGSFFLYSKLTVDKSR WQQGNVFSCSVMHEALHNHYTQKSLSLSPGK |
| 427 | D2C | CDH3-14 xI2C-scFc | Bispecific HLE molecule aa | QVQLQESGPGLVKPSETLSLTCTVSGGSITSYPINWIRQPPGKGLEWIGVIWTGGGTN YNPSLKSRVTISVDTSKNQFSLKLSSVTAADTAVYYCARSRGVYDFDGRGAMDYWG QGTLVTVSSGGGGSGGGGSGGGGSDIVMTQSPDSLAVSLGERATINCKSSQSLLYSSN QKNYLAWYQQKPGQPPKLLIYWASTRESGVPDRFSGSGSGTDFTLTISSLQAEDVAV YYCQQYYSYPYTFGQGTKLEIKSGGGGSEVQLVESGGGLVQPGGSLKLSCAASGFTF NKYAMNWVRQAPGKGLEWVARIRSKYNNYATYYADSVKDRFTISRDDSKNTAYLQ MNNLKTEDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVLGG GGDKTHTCPPCPAPELLGGPSVFLFPPKPKDTLMISRTPEVTCVVVDVSHEDPEVKFN WYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPEN NYKTTPPVLDSDGSFFLYSKLTVDKSRWQQGNVFSCSVMHEALHNHYTQKSLSLSPG KGGGGSGGGGSGGGGSGGGGSGGGGSDKTHTCPPCPAPELLGGPSVFLFPPK PKDTLMISRTPEVTCVVVDVSHEDPEVKFNWYVDGVEVHNAKTKPCEEQYGSTYRC VSVLTVLHQDWLNGKEYKCKVSNKALPAPIEKTISKAKGQPREPQVYTLPPSREEMT KNQVSLTCLVKGFYPSDIAVEWESNGQPENNYKTTPPVLDSDGSFFLYSKLTVDKSR WQQGNVFSCSVMHEALHNHYTQKSLSLSPGK |
| 428 | D3A | CDH3-24 xF12q- scFc | Bispecific HLE molecule aa | QVQLVQSGAEVKKPGASVKVSCKASGYTFTSYWMHWVRQAPGQGLEWMGVIDTS DSYTIYNQKFQGRVTMTRDTSTSTAYMELSSLRSEDTAVYYCARSGPGYFDVWGQG TMVTVSSGGGGSGGGGSGGGGSDIQLTQSPSFLSASVGDRVTITCRASGNIHNYLAW YQQKPGKAPKLLIYNAKTLADGVPSRFSGSGSGTEFTLKISSLQPEDFATYYCQHFWS TPYTFGQGTKLEIKSGGGGSEVQLVESGGGLVQPGGSLRLSCAASGFTFNSYAMNWV RQAPGKGLEWVARIRSKYNNYATYYADSVKGRFTISRDDSKNTAYLQMNSLKTEDT AVYYCVRHGNFGNSYVSWWAYWGQGTLVTVSSGGGGSGGGGSGGGGSQTVVTQE PSLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGKGGGGSG GGGSGGGGSGGGGSGGGGSDKTHTCPPCPAPELLGGPSVFLFPPKPKDTLMI SRTPEVTCVVVDVSHEDPEVKFNWYVDGVEVHNAKTKPCEEQYGSTYRCVSVLTVL HQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVF SCSVMHEALHNHYTQKSLSLSPGK |
| 429 | D3A | CDH3-24 xI2C-scFc | Bispecific HLE molecule aa | QVQLVQSGAEVKKPGASVKVSCKASGVTFYSYWMHWVRQAPGQGLEWMGVIDTS DSYTIYNQKFQGRVTMTRDTSTSTAYMELSSLRSEDTAVYYCARSGPGYFDVWGQG TMVTVSSGGGGSGGGGSGGGGSDIQLTQSPSFLSASVGDRVTITCRASGNIHNYLAW YQQKPGKAPKLLIYNAKTLADGVPSRFSGSGSGTEFTLKISSLQPEDFATYYCQHFWS TPYTFGQGTKLEIKSGGGGSEVQLVESGGGLVQPGGSLKLSCAASGFTFNKYAMNW VRQAPGKGLEWVARIRSKYNNYATYYADSVKDRFTISRDDSKNTAYLQMNNLKTE DTAVYYCVRHGNRINSYISYWAYWGQGTLVTVSSGGGGSGGGGSGGGGSQTVVTQ EPSLTVSPGGTVTLTCGSSTGAVTSGNYPNWVQQKPGQAPRGLIGGTKFLAPGTPAR FSGSLLGGKAALTLSGVQPEDEAEYYCVLWYSNRWVFGGGTKLTVLGGGGDKTHT CPPCPAPELLGGPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPP |

| SEQ ID NO | Epitope Designation | Format/ Source | Type | Sequence |
|---|---|---|---|---|
| | | | | VLDSDGSFFLYSKLTVDKSRWQQGNVFSCSVMHEALHNHYTQKSLSLSPGKGGGGS GGGGSGGGGSGGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGSTYRCVSVLTV LHQDWLNGKEYKCKVSNKALPAPIEKTISKAKGQPREPQVYTLPPSREEMTKNQVSL TCLVKGFYPSDIAVEWESNGQPENNYKTTPPVLDSDGSFFLYSKLTVDKSRWQQGNV FSCSVMHEALHNHYTQKSLSLSPGK |
| 430D3A | CDH3-25 xF12q-scFc | Bispecific HLE molecule | aa | QVQLVQSGAEVKKPGASVKVSCKASGYTFTSYWMHWVRQAPGQGLEWMGVIDTS DSYTIYNQKFKGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLIYNAKTLAEGVPSRFSGSGSGTEFTLTISSLQPEDFATYYCQHHYG TPYTFGQGTKLEIKSGGGGSEVQLVESGGGLVQPGGSLRLSCAASGFTFNSYAMNWV RQAPGKGLEWVARIRSKYNNYATYYADSVKGRFTISRDDSKNTAYLQMNSLKTEDT AVYYCVRHGNFGNSYVSWWAYWGQGTLVTVSSGGGGSGGGGSGGGGSQTVVTQE PSLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGKGGGGS GGGGSGGGGSGGGGSGGGGSGGGGSDKTHTCPPCPAPELLGGPSVFLFPPKPKDTLMI SRTPEVTCVVVDVSHEDPEVKFNWYVDGVEVHNAKTKPCEEQYGSTYRCVSVLTVL HQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVF SCSVMHEALHNHYTQKSLSLSPGK |
| 431D3A | CDH3-25 xI2C-scFc | Bispecific HLE molecule | aa | QVQLVQSGAEVKKPGASVKVSCKASGYTFTSYWNIHNVVRQAPGQGLEWMGVIDTS DSYTIYNQKFKGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLIYNAKTLAEGVPSRFSGSGSGTEFTLTISSLQPEDFATYYCQHHYG TPYTFGQGTKLEIKSGGGGSEVQLVESGGGLVQPGGSLKLSCAASGFTFNKYAMNW VRQAPGKGLEWVARIRSKYNNYATYYADSVKDRFTISRDDSKNTAYLQMNNLKTE DTAVYYCVRHGNEGNSYISYWAYWGQGTLVTVSSGGGGSGGGGSGGGGSQTVVTQ EPSLTVSPGGTVTLTCGSSTGAVTSGNYPNWVQQKPGQAPRGLIGGTKFLAPGTPAR FSGSLLGGKAALTLSGVQPEDEAEYYCVLWYSNRWVFGGGTKLTVLGGGGDKTHT CPPCPAPELLGGPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGKGGGGS GGGGSGGGGSGGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGSTYRCVSVLTV LHQDWLNGKEYKCKVSNKALPAPIEKTISKAKGQPREPQVYTLPPSREEMTKNQVSL TCLVKGFYPSDIAVEWESNGQPENNYKTTPPVLDSDGSFFLYSKLTVDKSRWQQGNV FSCSVMHEALHNHYTQKSLSLSPGK |
| 432D3A | CDH3-26 xF12q-scFc | Bispecific HLE molecule | aa | QVQLVQSGAEVKKPGASVKVSCKASGYIFTSYWMHWVRQAPGQGLEWMGVIDTS DSYTIYNQKFQGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLVYNAKTLAEGVPSRFSGSGSGTEFTLTISSLQPEDFATYYCQHHY GTPYTFGQGTKLEIKSGGGGSEVQLVESGGGLVQPGGSLRLSCAASGFTFNSYAMNW VRQAPGKGLEWVARIRSKYNNYATYYADSVKGRFTISRDDSKNTAYLQMNSLKTED TAVYYCVRHGNFGNSYVSWWAYWGQGTLVTVSSGGGGSGGGGSGGGGSQTVVTQ EPSLTVSPGGTVTLTCGSSTGAVTSGNYPNWVQQKPGQAPRGLIGGTKFLAPGTPAR FSGSLLGGKAALTLSGVQPEDEAEYYCVLWYSNRWVFGGGTKLTVLGGGGDKTHT CPPCPAPELLGGPSVFLFPPKPKDTLMISRTPEVTCVVVDVSHEDPEVKFNWYVDGVE VHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGKGGGGS GGGGSGGGGSGGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGSTYRCVSVLTV LHQDWLNGKEYKCKVSNKALPAPIEKTISKAKGQPREPQVYTLPPSREEMTKNQVSL TCLVKGFYPSDIAVEWESNGQPENNYKTTPPVLDSDGSFFLYSKLTVDKSRWQQGNV FSCSVMHEALHNHYTQKSLSLSPGK |
| 433D3A | CDH3-26 xI2C-scFc | Bispecific HLE molecule | aa | QVQLVQSGAEVICKPGASVKVSCKASGYTFTSYWMHWVRQAPGQGLEWMGVIDTS DSYTIYNQKFQGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLVYNAKTLAEGVPSRFSGSGSGTEFTLTISSLQPEDFATYYCQHHY GTPYTFGQGTKLEIKSGGGGSEVQLVESGGGLVQPGGSLRLSCAASGFTFNKYAMN WVRQAPGKGLEWVARIRSKYNNYATYYADSVKDRFTISRDDSKNTAYLQMNNLKT EDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVLGGGGDKTH |

-continued

| BAYER II SEQUENCES | | | | |
|---|---|---|---|---|
| SEQ ID NO | Epitope Designation | Format/ Source | Type | Sequence |
| | | | | TCPPCPAPELLGGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALPAPIEKTISK AKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGKGGGG SGGGGSGGGGSGGGGSGGGGSGGGGSDKTHTCPPCPAPELLGGPSVFLFPPKPKDTL MISRTPEVTCVVVDVSHEDPEVKFNWYVDGVEVHNAKTKPCEEQYGSTYRCVSVLT VLHQDWLNGKEYKCKVSNKALPAPIEKTISKAKGQPREPQVYTLPPSREEMTKNQVS LTCLVKGFYPSDIAVEWESNGQPENNYKTTPPVLDSDGSFFLYSKLTVDKSRWQQGN VFSCSVMHEALHNHYTQKSLSLSPGK |
| 434D3A | CDH3-27 xF12q- scFc | Bispecific HLE molecule | aa | QVQLVQSGAEVKKPGASVKVSCKASGYTFTSYWMHWVRQAPGQGLEWMGVIDTS DSYTIYAQKFQGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLIYNAKTLAEGVPSRFSGSGSGTEFTLTISSLQPEDFATYYCQHHYG TPYTFGQGTKLEIKSGGGGSEVQLVESGGGLVQPGGSLRLSCAASGFTFNSYAMNWV RQAPGKGLEWVARIRSKYNNYATYYADSVKGRFTISRDDSKNTAYLQMNSLKTEDT AVYYCVRHGNFGNSYVSWWAYWGQGTLVTVSSGGGGSGGGGSGGGGSQTVVTQE PSLTVSPGGTVTLTCGSSTGAVTSGNYPNWVQQKPGQAPRGLIGGTKFLAPGTPARFS GSLLGKAALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAPIEKTISKAK GQPREPQWTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGKGGGGSG GGGSGGGGSGGGGSGGGGSDKTHTCPPCPAPELLGGPSVFLFPPKPKDTLMI SRTPEVTCVVVDVSHEDPEVKFNWYVDGVEVHNAKTKPCEEQYGSTYRCVSVLTVL HQDVVINGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVF SCSVMHEALHNHYTQKSLSLSPGK |
| 435D3A | CDH3-27 xI2C-scFc | Bispecific HLE molecule | aa | QVQLVQSGAEVKKPGASVKVSCKASGYTFTSYWMHWVRQAPGQGLEWMGVIDTS DSYTIYAQKFQGRVTMTRDTSTSTVYMELSSLRSEDTAVYYCARSGPGYFDVWGQG TMVTVSSGGGGSGGGGSGGGGSDIQLTQSPSFLSASVGDRVTITCRASENIYSYLAW YQQKPGKAPKLLIYNAKTLAEGVPSRFSGSGSGTEFTLTISSLQPEDFATYYCQHHYG TPYTFGQGTKLEIKSGGGGSEVQLVESGGGLVQPGGSLKLSCAASGFTFNKYAMNW VRQAPGKGLEWVARIRSKYNNYATYYADSVKDRFTISRDDSKNTAYLQMNNLKTE DTAVYYCVRHGNFGNSYISYWAYWGQGTLVTVSKIGGGSGGGGSGGGGSQTVVTQ EPSLTVSPGGTVTLTCGSSTGAVTSGNYPNWVQQKPGQAPRGLIGGTKFLAPGTPAR FSGSLLGKAALTLSGVQPEDEAEYYCVLWYSNRWVFGGGTKLTVLGGGGDKTHT CPPCPAPELLGGPSVFLFPPKPKDTLMISRTPENTCVVVDVSHEDPEVKFNWYVDGVE VHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGKGGGGS GGGGSGGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGSTYRCVSVLTV LHQPWLNGKEYKCKVSNKALPAPIEKTISKAKGQPREPQVYTLPPSREEMTKNQVSL TCLVKGFYPSDIAVEWESNGQPENNYKTTPPVLDSDGSFFLYSKLTVDKSRWQQGNV FSCSVMHEALHNHYTQKSLSLSPGK |
| 436 | Hexa-his | artificial | aa | HHHHHH |
| 437 | P156 | artificial | aa | RDWDFDVFGGGTPVGG |
| 438 | linear FcRn BP | artificial | aa | QRFVTGHFGGLXPANG |
| 439 | linear FcRn BP-Y | artificial | aa | QRFVTGHFGGLYPANG |
| 440 | linear FcRn BP-H | artificial | aa | QRFVTGHFGGLHPANG |
| 441 | core FcRn BP-H | artificial | aa | TGHFGGLHP |
| 442 | cyclic FcRn BP-H | artificial | aa | QRFCTGHFGGLHPCNG |
| 443 | HALB | human | aa | DAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNL PRLVRPEVDVMCTAFHDNEETFLKKYLYEIARRHPYFYAPELLFFAKRYKAAFTECC QAADKAACLLPKLDELRDEGKASSAKQRLKCASLQKFGERAFKAWAVARLSQRFPK AEFAEVSKLVTDLTKVHTECCHGDLLECADDRADLAKYICENQDSISSKLKECCEKP LLEKSHCIAEVENDEMPADLPSLAADFVESKDVCKNYAEAKDVFLGMFLYEYARRH |

-continued

| | | BAYER II SEQUENCES | | |
|---|---|---|---|---|
| SEQ ID NO | Epitope Designation | Format/ Source | Type | Sequence |
| | | | | PDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAED YLSVVLNQLCVLHEKTPVSDRVTKCCTESLVNRRPCFSALEVDETYVPKEFNAETFTF HADICTLSEKERQIKKQTALVELVKHKPKATKEQLKAVMDDFAAFVEKCCKADDKE TCFAEEGKKLVAASQAALGL |
| 444 | HALB variant 1 | human | aa | DAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNL PRLVRPEVDVMCTAFHDNEETFLKKYLYEIARRHPYFYAPELLFFAKRYKAAFTECC QAADKAACLLPKLDELRDEGKASSAKQRLKCASLQKFGERAFKAWAVARLSQRFPK AEFAEVSKLVTDLTKVHTECCHGDLLECADDRADLAKYICENQDSISSKLKECCEKP LLEKSHCIAEVENDEMPADLPSLAADFVESKDVCKNYAEAKDVFLGMFLYEYARRH PDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAED SVVLNQLCVLHEKTPVSDRVTKCCTESLVNRRPCFSALEVDETYVPKEFNAGTFT FHADICTLSEKERQIKKQTALVELVKHKPKATKEQLKAAMDDFAAFVEKCCKADDK ETCFAEEGKKLVAASQAALGL |
| 445 | CDR-L1 of F6A | artificial | aa | GSSTGAVTSGYYPN |
| 446 | CDR-L2 of F6A | artificial | aa | GTKFLAP |
| 447 | CDR-L3 of F6A | artificial | aa | ALWYSNRWV |
| 448 | CDR-H1 of F6A | artificial | aa | IYAMN |
| 449 | CDR-H2 of F6A | artificial | aa | RIRSKYNNYATYYADSVKS |
| 450 | CDR-H3 of F6A | artificial | aa | HGNFGNSYVSFFAY |
| 451 | VH of F6A | artificial | aa | EVQLVESGGGLVQPGGSLKLSCAASGFTFNIYAMNWVRQAPGKGLEWVARIRSKYN NYATYYADSVKSRFTISRDDSKNTAYLQMNNLKTEDTAVYYCVRHGNFGNSYVSFF AYWGQGTLVTVSS |
| 452 | VL of F6A | artificial | aa | QTVVTQEPSLTVSPGGTVTLTCGSSTGAVTSGYYPNWVQQKPGQAPRGLIGGTKFLA PGTPARFSGSLLGGKAALTLSGVQPEDEAEYYCALWYSNRWVFGGGTKLTVL |
| 453 | VH-VL of F6A | artificial | aa | EVQLVESGGGLVQPGGSLKLSCAASGFTFNIYAMNWVRQAPGKGLEWVARIRSKYN NYATYYADSVKSRFTISRDDSKNTAYLQMNNLKTEDTAVYYCVRHGNFGNSYVSFF AYWGQGTLVTVSSGGGGSGGGGSGGGGSQTVVTQEPSLTVSPGGTVTLTCGSSTGA VTSGYYPNWVQQKPGQAPRGLIGGTKFLAPGTPARFSGSLLGGKAALTLSGVQPEDE AEYYCALWYSNRWVFGGGTKLTVL |
| 454 | CDR-L1 of H2C | artificial | aa | GSSTGAVTSGYYPN |
| 455 | CDR-L2 of H2C | artificial | aa | GTKFLAP |
| 456 | CDR-L3 of H2C | artificial | aa | ALWYSNRWV |
| 457 | CDR-H1 of H2C | artificial | aa | KYAMN |
| 458 | CDR-H2 of H2C | artificial | aa | RIRSKYNNYATYYADSVKD |
| 459 | CDR-H3 of H2C | artificial | aa | HGNFGNSYISYWAY |
| 460 | VH of H2C | artificial | aa | EVQLVESGGGLVQPGGSLKLSCAASGFTFNKYAMNWVRQAPGKGLEWVARIRSKY NNYATYYADSVKDRFTISRDDSKNTAYLQMNNLKTEDTAVYYCVRHGNFGNSYISY WAYWGQGTLVTVSS |
| 461 | VL of H2C | artificial | aa | QTVVTQEPSLTVSPGGTVTLTCGSSTGAVTSGYYPNWVQQKPGQAPRGLIGGTKFLA PGTPARFSGSLLGGKAALTLSGVQPEDEAEYYCALWYSNRWVFGGGTKLTVL |

BAYER II SEQUENCES

| SEQ ID NO | Epitope Designation | Format/ Source | Type | Sequence |
|---|---|---|---|---|
| 462 | VH-VL of H2C | artificial | aa | EVQLVESGGGLVQPGGSLKLSCAASGFTFNKYAMNWVRQAPGKGLEWVARIRSKY NNYATYYADSVKDRFTISRDDSKNTAYLQMNNLKTEDTAVYYCVRHGNFGNSYISY WAYWGQGTLVTVSSGGGGSGGGGSGGGGSQTVVTQEPSLTVSPGGTVTLTCGSSTG AVTSGYYPNWVQQKPGQAPRGLIGGTKFLAPGTPARFSGSLLGGKAALTLSGVQPED EAEYYCALWYSNRWVFGGGTKLTVL |
| 463 | CDR-L1 of H1E | artificial | aa | GSSTGAVTSGYYPN |
| 464 | CDR-L2 of H1E | artificial | aa | GTKFLAP |
| 465 | CDR-L3 of H1E | artificial | aa | ALWYSNRWV |
| 466 | CDR-H1 of H1E | artificial | aa | SYAMN |
| 467 | CDR-H2 of H1E | artificial | aa | RIRSKYNNYATYYADSVKG |
| 468 | CDR-H3 of H1E | artificial | aa | HGNFGNSYLSFWAY |
| 469 | VH of H1E | artificial | aa | EVQLVESGGGLEQPGGSLKLSCAASGFTFNSYAMNWVRQAPGKGLEWVARIRSKYN NYATYYADSVKGRFTISRDDSKNTAYLQMNNLKTEDTAVYYCVRHGNFGNSYLSF WAYWGQGTLVTVSS |
| 470 | VL of H1E | artificial | aa | QTVVTQEPSLTVSPGGTVTLTCGSSTGAVTSGYYPNWVQQKPGQAPRGLIGGTKFLA PGTPARFSGSLLGGKAALTLSGVQPEDEAEYYCALWYSNRWVFGGGTKLTVL |
| 471 | VH-VL of H1E | artificial | aa | EVQLVESGGGLEQPGGSLKLSCAASGFTFNSYAMNWVRQAPGKGLEWVARIRSKYN NYATYYADSVKGRFTISRDDSKNTAYLQMNNLKTEDTAVYYCVRHGNFGNSYLSF WAYWGQGTLVTVSSGGGGSGGGGSGGGGSQTVVTQEPSLTVSPGGTVTLTCGSSTG AVTSGYYPNWVQQKPGQAPRGLIGGTKFLAPGTPARFSGSLLGGKAALTLSGVQPED EAEYYCALWYSNRWVFGGGTKLTVL |
| 472 | CDR-L1 of G4H | artificial | aa | GSSTGAVTSGYYPN |
| 473 | CDR-L2 of G4H | artificial | aa | GTKFLAP |
| 474 | CDR-L3 of G4H | artificial | aa | ALWYSNRWV |
| 475 | CDR-H1 of G4H | artificial | aa | RYAMN |
| 476 | CDR-H2 of G4H | artificial | aa | RIRSKYNNYATYYADSVKG |
| 477 | CDR-H3 of G4H | artificial | aa | HGNFGNSYLSYFAY |
| 478 | VH of G4H | artificial | aa | EVQLVESGGGLVQPGGSLKLSCAASGFTFNRYAMNWVRQAPGKGLEWVARIRSKY NNYATYYADSVKGRFTISRDDSKNTAYLQMNNLKTEDTAVYYCVRHGNFGNSYLS YFAYWGQGTLVTVSS |
| 479 | VL of G4H | artificial | aa | QTVVTQEPSLTVSPGGTVTLTCGSSTGAVTSGYYPNWVQQKPGQAPRGLIGGTKFLA PGTPARFSGSLLGGKAALTLSGVQPEDEAEYYCALWYSNRWVFGGGTKLTVL |
| 480 | VH-VL of G4H | artificial | aa | EVQLVESGGGLVQPGGSLKLSCAASGFTFNRYAMNWVRQAPGKGLEWVARIRSKY NNYATYYADSVKGRFTISRDDSKNTAYLQMNNLKTEDTAVYYCVRHGNFGNSYLS YFAYWGQGTLVTVSSGGGGSGGGGSGGGGSQTVVTQEPSLTVSPGGTVTLICGSST GAVTSGYYPNWVQQKPGQAPRGLIGGTKFLAPGTPARFSGSLLGGKAALTLSGVQPE DEAEYYCALWYSNRWVFGGGTKLTVL |
| 481 | CDR-L1 of A2J | artificial | aa | RSSTGAVTSGYYPN |

| | | BAYER II SEQUENCES | | |
|---|---|---|---|---|
| SEQ ID NO | Epitope Designation | Format/ Source | Type | Sequence |
| 482 | CDR-L2 of A2J | artificial | aa | ATDMRPS |
| 483 | CDR-L3 of A2J | artificial | aa | ALWYSNRWV |
| 484 | CDR-H1 of A2J | artificial | aa | VYAMN |
| 485 | CDR-H2 of A2J | artificial | aa | RIRSKYNNYATYYADSVKK |
| 486 | CDR-H3 of A2J | artificial | aa | HGNFGNSYLSWWAY |
| 487 | VH of A2J | artificial | aa | EVQLVESGGGLVQPGGSLKLSCAASGFTFNVYAMNWVRQAPGKGLEWVARIRSKY NNYATYYADSVKKRFTISRDDSKNTAYLQMNNLKTEDTAVYYCVRHGNFGNSYLS WWAYWGQGTLVTVSS |
| 488 | VL of A2J | artificial | aa | QTVVTQEPSLTVSPGGTVTLTCRSSTGAVTSGYYPNWVQQKPGQAPRGLIGATDMRP SGTPARFSGSLLGGKAALTLSGVQPEDEAEYYCALWYSNRWVFGGGTKLTVL |
| 489 | VH-VL of A2J | artificial | aa | EVQLVESGGGLVQPGGSLKLSCAASGFTFNVYAMNWVRQAPGKGLEWVARIRSKY NNYATYYADSVKKRFTISRDDSKNTAYLQMNNLKTEDTAVYYCNRHGNFGNSYLS WWAYWGQGTLVTVSSGGGGSGGGGSGGGGSQTVVTQEPSLTVSPGGTVTLTCRSST GAVTSGYYPNWVQQKPGQAPRGLIGATDMRPSGTPARFSGSLLGGKAALTLSGVQP EDEAEYYCALWYSNRWVFGGGTKLTVL |
| 490 | CDR-L1 of E1L | artificial | aa | GSSTGAVTSGYYPN |
| 491 | CDR-L2 of E1L | artificial | aa | GTKFLAP |
| 492 | CDR-L3 of E1L | artificial | aa | ALWYSNRWV |
| 493 | CDR-H1 of E1L | artificial | aa | KYAMN |
| 494 | CDR-H2 of E1L | artificial | aa | RIRSKYNNYATYYADSVKS |
| 495 | CDR-H3 of E1L | artificial | aa | HGNFGNSYTSYYAY |
| 496 | VH of E1L | artificial | aa | EVQLVESGGGLVQPGGSLKLSCAASGFTFNKYAMNWVRQAPGKGLEWVARIRSKY NNYATYYADSVKSRFTISRDDSKNTAYLQMNNLKTEDTAVYYCVRHGNFGNSYTSY YAYWGQGTLVTVSS |
| 497 | VL of E1L | artificial | aa | QTVVTQEPSLTVSPGGTVTLTCGSSTGAVTSGYYPNWVQQKPGQAPRGLIGGTKFLA PGTPARFSGSLLGGKAALTLSGVQPEDEAEYYCALWYSNRWVFGGGTKLTVL |
| 498 | VH-VL of E1L | artificial | aa | EVQLVESGGGLVQPGGSLKLSCAASGFTFNKYAMNWVRQAPGKGLEWVARIRSKY NNYATYYADSVKSRFTISRDDSKNTAYLQMNNLKTEDTAVYYCVRHGNFGNSYTSY YAYWGQGTLVTVSSGGGGSGGGGSGGGGSQTVVTQEPSLTVSPGGTVTLTCGSSTG AVTSGYYPNWVQQKPGQAPRGLIGGTKFLAPGTPARFSGSLLGGKAALTLSGVQPED EAEYYCALWYSNRWVFGGGTKLTVL |
| 499 | CDR-L1 of E2M | artificial | aa | RSSTGAVTSGYYPN |
| 500 | CDR-L2 of E2M | artificial | aa | ATDMRPS |
| 501 | CDR-L3 of E2M | artificial | aa | ALWYSNRWV |
| 502 | CDR-H1 of E2M | artificial | aa | GYAMN |

BAYER II SEQUENCES

| SEQ ID NO | Epitope Designation | Format/ Source | Type | Sequence |
|---|---|---|---|---|
| 503 | CDR-H2 of E2M | artificial | aa | RIRSKYNNYATYYADSVKE |
| 504 | CDR-H3 of E2M | artificial | aa | HRNFGNSYLSWFAY |
| 505 | VH of E2M | artificial | aa | EVQLVESGGGLVQPGGSLKLSCAASGFTFNGYAMNWVRQAPGKGLEWVARIRSKY NNYATYYADSVKERFTISRDDSKNTAYLQMNNLKTEDTAVYYCVRHRNFGNSYLS WFAYWGQGTLV -continued

| | | | | |
|---|---|---|---|---|
| | | BAYER II SEQUENCES | | |
| SEQ ID NO | Epitope Designation | Format/ Source | Type | Sequence |
| 523 | VH of F12Q | artificial | aa | EVQLVESGGGLVQPGGSLKLSCAASGFTFNSYAMNWVRQAPGKGLEWVARIRSKY NNYATYYADSVKGRFTISRDDSKNTAYLQMNNLKTEDTAVYYCVRHGNFGNSYVS WWAYWGQGTLVTVSS |
| 524 | VL of F12Q | artificial | aa | QTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 525 | VH-VL of F12Q | artificial | aa | EVQLVESGGGLVQPGGSLKLSCAASGFTFNSYAMNWVRQAPGKGLEWVARIRSKY NNYATYYADSVKGRFTISRDDSKNTAYLQMNNLKTEDTAVYYCVRHGNFGNSYVS WWAYWGQGTLVTVSSGGGGSGGGGSGGGGSQTVVTQEPSLTVSPGGTVTLTCGSS TGAVTSGNYPNWVQQKPGQAPRGLIGGTKFLAPGTPARFSGSLLGGKAALTLSGVQP EDEAEYYCVLWYSNRWVFGGGTKLTVL |
| 526 | CDR-L1 of I2C | artificial | aa | GSSTGAVTSGNYPN |
| 527 | CDR-L2 of I2C | artificial | aa | GTKFLAP |
| 528 | CDR-L3 of I2C | artificial | aa | VLWYSNRWV |
| 529 | CDR-H1 of I2C | artificial | aa | KYAMN |
| 530 | CDR-H2 of I2C | artificial | aa | RIRSKYNNYATYYADSVKD |
| 531 | CDR-H3 of I2C | artificial | aa | HGNFGNSYISYWAY |
| 532 | VH of I2C | artificial | aa | EVQLVESGGGLVQPGGSLKLSCAASGFTFNKYAMNWVRQAPGKGLEWVARIRSKY NNYATYYADSVKDRFTISRDDSKNTAYLQMNNLKTEDTAVYYCVRHGNFGNSYISY WAYWGQGTLVTVSS |
| 533 | VL of I2C | artificial | aa | QTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 534 | VH-VL of I2C | artificial | aa | EVQLVESGGGLVQPGGSLKLSCAASGFTFNKYAMNWVRQAPGKGLEWVARIRSKY NNYATYYADSVKDRFTISRDDSKNTAYLQMNNLKTEDTAVYYCVRHGNFGNSYISY WAYWGQGTLVTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAALTLSGVQPED EAEYYCVLWYSNRWVFGGGTKLTVL |
| 535 | VH of F12q | artificial | aa | EVQLVESGGGLVQPGGSLRLSCAASGFTFNSYAMNWVRQAPGKGLEWVARIRSKYN NYATYYADSVKGRFTISRDDSKNTAYLQMNSLKTEDTAVYYCVRHGNFGNSYVSW WAYWGQGTLVTVSS |
| 536 | VL of F12q | artificial | aa | QTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 537 | VH-VL of F12q | artificial | aa | EVQLVESGGGLVQPGGSLRLSCAASGFTFNSYAMNWVRQAPGKGLEWVARIRSKYN NYATYYADSVKGRFTISRDDSKNTAYLQMNSLKTEDTAVYYCVRHGNFGNSYVSW WAYWGQGTINTVSSGGGGSGGGGSGGGGSQTVVTQEPSLTVSPGGTVTLTCGSSTG AVTSGNYPNWVQQKPGQAPRGLIGGTKFLAPGTPARFSGSLLGGKAALTLSGVQPED EAEYYCVLWYSNRWVFGGGTKLTVL |

SEQUENCE LISTING (543 sequences)

SEQ ID NO: 1 - protein, 829 aa, Homo sapiens
  MISC_FEATURE: Human CDH3
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 2 - DNA, 2487 bp, Homo sapiens
  MISC_FEATURE: Human CDH3
atggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgac

SEQ ID NO: 3 - protein, 654 aa, Homo sapiens
  MISC_FEATURE: Human CDH3 ECD
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGG

SEQ ID NO: 4 - DNA, 1962 bp, Homo sapiens
  MISC_FEATURE: Human CDH3 ECD
atggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggt

SEQ ID NO: 5 - protein, 829 aa, Macaca fascicularis
  MISC_FEATURE: Macaque CDH3
MGLPRGPLACLLLVQVCWLQCAASEPCRAIFGEAEVTLEAGGAEQEPSQALGKVFMGCPGQKPALFSTVNDDFTVQNGETVQDRKSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIHTYNGVVAYSIHSQEPKDPHDLMFTIHRSTGTISVISSGLDREKVPEYTLTIQATDMDGDGSTTTAVAVVEILDANDNAPVFDPQKYESHVPENAVGHEVQRLTVTDLDAPNSPAWRATYLIVGGDDGDHFTIATHPESNQGILTTRKGLDFEAKNQHTLYVEVTNEAPFVLKLPTSTATIVVHVEDVNEAPVFVPPSKVVEVQEGIPTGEAVCVYTAKDPDKENQKISYRILRDPAGWLAMDPDSGQVTVAGTLDREDERFVRNNIYEVMVLAVDNGSPPTTGTGTLLLTLIDVNDHGPVPEPREITICNQSPESQVLNITDKDLSPHTSPFQAQLTDDSDIYWMAEVNEKDDTVVLSLKKFLKQDTYDVHLSLSDHGNKEQLTVIRATVCDCHGHVEKCPDPWKGGFILPVLGAVLALLLLLLVLLLLVRKKRKVKEPLLLPEDDTRDNVFYYGEEGGGEEDQDYDITQLHRGLEARPEVVLRNDVAPTFIPTPMYRPRPANPDEIGNFIIENLKAANTDPTAPPYDSLLVFDYEGSGSDAASLSSLTTSTSDQDQDYDYLNEWGSRFKKLADMYGGGDDD

SEQ ID NO: 6 - DNA, 2487 bp, Macaca fascicularis
  MISC_FEATURE: Macaque CDH3
atggggctccctcgtggacctctcgcgtgtctcctcctcgtccaggtttgctggctgcaatgcgcggcctccgagccgtgccgggcgatcttcggggaggctgaagtgaccttggaggcgggaggcgcggagcaggagcccagccaggccctggggaaagtattcatgggctgccctgggcaaaagccagctctgtttagcactgttaatgacgacttcactgtgcagaatggcgagacagtccaggacagaaagtcactgaaagaaaggaatccattgaagatcttcccatccaaacgtatcttacgaagacacaagagagattgggtggttgctccaatatctgtccctgaaaatggcaagggtcccttcccgcagaggctgaatcagctcaagtctaataaagacagagacacgaagattttctacagcatcacggggccgggggcagacagcccccctgagggcgtctttgctgtagagaaagagacaggctggttgttgttgaacaagccactggaccgggaggagattgccaagtatgagctctttggccacgctgtgtcagagaatggtgcctcagtggaggatcccatgaacatctccatcatcgtgaccgaccagaatgaccacaagcccaagtttacccaggacaccttccgagggagtgtcttagagggagtcctaccaggtacttctgtgatgcaggtgacggccacagatgaggatgatgccatccacacctacaatggggtggttgcgtactccatccatagccaagaaccaaaggatccacacgacctgatgtttaccattcaccggagcacaggcaccatcagcgtcatctccagcggcctggaccgggaaaaagtccctgagtacacactgaccatccaggccacagacatggatggggacggctccaccaccacggcagtggcagtagtggagatcctcgatgccaatgacaatgctcccgtgtttgacccccagaagtatgagtcccatgtgcctgagaatgcagtgggccatgaggtgcagaggctgacggtcactgatctggacgcccccaactcaccagcgtggcgtgccacctacctcatcgtgggcggtgacgacggggaccattttaccatcgccacccaccctgagagcaaccagggcatcctgacaaccaggaagggtttggattttgaggccaaaaaccagcacaccctgtacgttgaagtgaccaacgaggccccttttgtgctgaagctcccaacctcaacagccaccatagtggtccacgtggaggatgtgaatgaggcacccgtgtttgtcccgccctccaaagtcgttgaggtccaggagggcatccccactggggaggctgtgtgtgtctacactgcaaaagaccctgacaaggagaatcaaaagatcagctaccgcatcctgagagacccagcagggtggctagccatggacccagacagtgggcaggtcactgttgcgggcaccctagaccgtgaggatgagcggtttgtgagaaacaacatctacgaagtcatggtcttggctgtggacaatggaagccctcccaccactggcacgggaaccctcctgctaacactgattgatgtcaacgaccatggcccagtccctgagccccgtgagatcaccatctgcaaccaaagccctgagtcccaggtgctgaacatcacggacaaggacctgtccccccacacctcccctttccaggcccagctcacagacgactcagacatctactggatggcagaggtcaacgagaaagatgacacggtggtcttgtccctgaagaagttcctgaagcaggacacatatgatgtgcacctttctctgtctgaccatggcaacaaggagcagctgacagtgatcagggccaccgtgtgtgactgccacggccatgtcgagaaatgccctgatccctggaaggggggtttcatcctccctgtgctgggggctgtcctggctctgctgctcctcctgctggtgctgctcttgttggtgagaaagaagcggaaggtcaaggagcccctcctactcccagaagatgacacccgtgacaacgtcttctactacggcgaagaggggggtggcgaagaggaccaggactatgacatcacccagctccaccgaggtctggaggccaggccggaggtggttctccgcaatgacgtggcaccaaccttcatccccacacccatgtaccgtcctcggccagccaacccagatgaaatcggcaactttataatcgagaacctgaaggcagctaacacggaccccacagccccgccctacgactcccttttggtgttcgactatgagggcagcggctccgacgccgcgtccctgagctccctcaccacctccacctctgaccaggaccaagattacgactatctgaacgagtggggcagccgcttcaagaagctggcagacatgtacggtggcggggacgacgac

SEQ ID NO: 7 - protein, 654 aa, Macaca fascicularis
  MISC_FEATURE: Macaque CDH3 ECD
MGLPRGPLACLLLVQVCWLQCAASEPCRAIFGEAEVTLEAGGAEQEPSQALGKVFMGCPGQKPALFSTVNDDFTVQNGETVQDRKSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIHTYNGVVAYSIHSQEPKDPHDLMFTIHRSTGTISVISSGLDREKVPEYTLTIQATDMDGDGSTTTAVAVVEILDANDNAPVFDPQKYESHVPENAVGHEVQRLTVTDLDAPNSPAWRATYLIVGGDDGDHFTIATHPESNQGILTTRKGLDFEAKNQHTLYVEVTNEAPFVLKLPTSTATIVVHVEDVNEAPVFVPPSKVVEVQEGIPTGEAVCVYTAKDPDKENQKISYRILRDPAGWLAMDPDSGQVTVAGTLDREDERFVRNNIYEVMVLAVDNGSPPTTGTGTLLLTLIDVNDHGPVPEPREITICNQSPESQVLNITDKDLSPHTSPFQAQLTDDSDIYWMAEVNEKDDTVVLSLKKFLKQDTYDVHLSLSDHGNKEQLTVIRATVCDCHGHVEKCPDPWKGG

SEQ ID NO: 8 - DNA, 1962 bp, Macaca fascicularis
  MISC_FEATURE: Macaque CDH3 ECD
atggggctccctcgtggacctctcgcgtgtctcctcctcgtccaggtttgctggctgcaatgcgcggcctccgagccgtgccgggcgatcttcggggaggctgaagtgaccttggaggcgggaggcgcggagcaggagcccagccaggccctggggaaagtattcatgggctgccctgggcaaaagccagctctgtttagcactgttaatgacgacttcactgtgcagaatggcgagacagtccaggacagaaagtcactgaaagaaaggaatccattgaagatcttcccatccaaacgtatcttacgaagacacaagagagattgggtggttgctccaatatctgtccctgaaaatggcaagggtcccttcccgcagaggctgaatcagctcaagtctaataaagacagagacacgaagattttctacagcatcacggggccgggggcagacagcccccctgagggcgtctttgctgtagagaaagagacaggctggttgttgttgaacaagccactggaccgggaggagattgccaagtatgagctctttggccacgctgtgtcagagaatggtgcctcagtggaggatcccatgaacatctccatcatcgtgaccgaccagaatgaccacaagcccaagtttacccaggacaccttccgagggagtgtcttagagggagtcctaccaggtacttctgtgatgcaggtgacggccacagatgaggatgatgccatccacacctacaatggggtggttgcgtactccatccatagccaagaaccaaaggatccacacgacctgatgtttaccattcaccggagcacaggcaccatcagcgtcatctccagcggcctggaccgggaaaaagtccctgagtacacactgaccatccaggccacagacatggatggggacggctccaccaccacggcagtggcagtagtggagatcctcgatgccaatgacaatgctcccgtgtttgacccccagaagtatgagtcccatgtgcctgagaatgcagtgggccatgaggtgcagaggctgacggtcactgatctggacgcccccaactcaccagcgtggcgtgccacctacctcatcgtgggcggtgacgacggggaccattttaccatcgccacccaccctgagagcaaccagggcatcctgacaaccaggaagggtttggattttgaggccaaaaaccagcacaccctgtacgttgaagtgaccaatgaggccccttttgtgctgaagctcccaacctcaacagccaccatagtggtccacgtggaggatgtgaatgaggcacccgtgtttgtcccgccctccaaagtcgttgaggtccaggagggcatccccactggggaggctgtgtgtgtctacactgcaaaagaccctgacaaggagaatcaaaagatcagctaccgcatcctgagagacccagcagggtggctagccatggacccagacagtgggcaggtcactgttgcgggcaccctagaccgtgaggatgagcggtttgtgagaaacaacatctacgaagtcatggtcttggctgtggacaatggaagccctcccaccactggcacgggaaccctcctgctaacactgattgatgtcaacgaccatggcccagtccctgagccccgtgagatcaccatctgcaaccaaagccctgagtcccaggtgctgaacatcacggacaaggacctgtccccccacacctcccctttccaggcccagctcacagacgactcagacatctactggatggcagaggtcaacgagaaagatgacacggtggtcttgtccctgaagaagttcctgaagcaggacacatatgatgtgcacctttctctgtctgaccatggcaacaaggagcagctgacagtgatcagggccaccgtgtgtgactgccacggccatgtcgagaaatgccctgatccctggaaggggggt

SEQ ID NO: 9 - protein, 822 aa, Mus musculus
  MISC_FEATURE: Murine CDH3
MELLSGPHAFLLLLLQVCWLRSVVSEPYRAGFIGEAGVTLEVEGTDLEPSQVLGKVALAGQGMHHADNGDIIMLTRGTVQGGKDAMHSPPTRILRRRKREWVMPPIFVPENGKGPFPQRLNQLKSNKDRGTKIFYSITGPGADSPPEGVFTIEKESGWLLLHMPLDREKIVKYELYGHAVSENGASVEEPMNISIIVTDQNDNKPKFTQDTFRGSVLEGVMPGTSVMQVTATDEDDAVNTYNGVVAYSIHSQEPKEPHDLMFTIHKSTGTISVISSGLDREKVPEYRLTVQATDMDGEGSTTTAEAVVQILDANDNAPEFEPQKYEAWVPENEVGHEVQRLTVTDLDVPNSPAWRATYHIVGGDDGDHFTITTHPETNQGVLTTKKGLDFEAQDQHTLYVEVTNEAPFAVKLPTATATVVVHVKDVNEAPVFVPPSKVIEAQEGISIGELVCIYTAQDPDKEDQKISYTISRDPANWLAVDPDSGQITAAGILDREDEQFVKNNVYEVMVLATDSGNPPTTGTGTLLLTLTDINDHGPIPEPRQIIICNQSPVPQVLNITDKDLSPNSSPFQAQLTHDSDIYWMAEVSEKGDTVALSLKKFLKQDTYDLHLSLSDHGNREQLTMIRATVCDCHGQVFNDCPRPWKGGFILPILGAVLALLTLLLALLLLVRKKRKVKEPLLLPEDDTRDNVFYYGEEGGGEEDQDYDITQLHRGLEARPEVVLRNDVVPTFIPTPMYRPRPANPDEIGNFIIENLKAANTDPTAPPYDSLLVFDYEGSGSDAASLSSLTTSASDQDQDYNYLNEWGSRFKKLADMYGGGEDD

SEQ ID NO: 10 - DNA, 2469 bp, Mus musculus
  MISC_FEATURE: Murine CDH3
atggagcttcttagtgggcctcacgccttcctgctcctcctgctccaggtttgctggctacgcagcgtggtctccgagccctaccgagcgggcttcatcggggaggctggagtgaccttggaggtggaaggaactgacctggagccgagccaagttctggggaaagtagccttggctggacagggcatgcaccatgcagacaatggagacatcattatgctgactagggggacagttcagggagggaaggatgcgatgcactccccacccacccgcatcttaaggagacgaaagagagagtgggtgatgccaccaatattcgtccccgagaatggcaagggtcccttccctcagaggctgaatcagctcaaatctaataaggacagaggcaccaagattttctacagcatcacagggcctggcgcagacagtccccccgaaggagtcttcaccatagagaaggagtcgggctggctgttgttgcatatgccactggacagggagaagattgtcaagtacgagctttatggccacgctgtatctgagaatggtgcctctgtagaggagcccatgaacatatccatcattgtgacagaccagaatgacaacaagcccaagttcactcaagacaccttcagagggagtgttctggagggagtaatgcctggcacttctgtgatgcaggtgacagccacagatgaggacgatgctgtcaacacttacaatggggtggtggcttactccatccatagccaagagccgaaggagccacacgacctcatgttcaccatccataaaagcacgggaaccattagcgtcatatccagtggcctggaccgagagaaagtccctgagtacagactgaccgtccaggccacagacatggatggagagggctctaccacgacggcagaggccgttgtgcaaatccttgatgccaacgataacgctcccgagtttgagccgcagaagtatgaggcttgggtgcctgagaacgaagtgggccatgaggtacagaggctgacagtgactgatctcgatgtccccaactcgccagcgtggcgtgccacctaccacatcgtgggaggtgatgatggggaccatttcaccatcaccactcacccagagaccaaccaaggcgtcctgacaaccaagaagggtttggattttgaggctcaggaccaacacaccctgtatgtagaagtgaccaacgaggctccctttgcagtgaagctcccgacagccactgccaccgtggtggtccatgtgaaagatgtcaacgaagcccctgtgtttgttccaccttccaaggtcattgaggcccaggaaggcatctctattggggaactggtctgcatctataccgcacaggacccagacaaggaggaccagaagatcagctacaccatctcgagagatccagccaactggcttgctgtggacccagacagtggtcagataactgccgcaggcatcttggatcgtgaggacgagcagtttgtgaaaaacaatgtctacgaagtcatggttttggccacagacagtggaaaccctcccaccaccggcactgggaccctcctgcttacacttactgacatcaacgaccatggcccgatccctgaacccaggcagatcatcatctgtaaccaaagccctgtgcctcaagtgctgaacatcactgacaaggacctgtcccccaactcctcccctttccaggcccagctaacacatgactcagatatctactggatggcagaagtcagcgagaaaggagacaccgtggccttgtccctgaagaagttcctgaaacaagacacgtatgacttgcatctttctttgtctgaccatggcaacagggaacagctaaccatgatcagggccactgtgtgtgactgccatggccaagtgttcaatgactgccccagaccctggaagggtggtttcatcctccccatcctgggtgctgtcctggcactgctgacccttctactggcactcctcctgttggtgaggaagaagaggaaggtcaaagagccccttctgctcccagaagatgacacgcgagacaatgtcttctattatggagaagagggtggtggtgaagaggaccaggactatgacatcacccaactccaccggggactggaggccaggcctgaggtggttctccgaaacgatgtagtgccaaccttcatccccacccccatgtaccgaccccggcccgccaacccagatgaaatcgggaacttcatcatcgagaacctgaaggctgccaacactgaccctactgccccgccctacgactccctgctggtttttgactacgagggcagcggctctgatgccgcctccctgagctccctcaccacctccgcctccgaccaggatcaggactacaactaccttaacgagtggggaagtcgattcaagaaactggcggacatgtatggtggcggtgaggatgactag

SEQ ID NO: 11 - protein, 548 aa, Mus musculus
  MISC_FEATURE: Murine CDH3 ECD
EWVMPPIFVPENGKGPFPQRLNQLKSNKDRGTKIFYSITGPGADSPPEGVFTIEKESGWLLLHMPLDREKIVKYELYGHAVSENGASVEEPMNISIIVTDQNDNKPKFTQDTFRGSVLEGVMPGTSVMQVTATDEDDAVNTYNGVVAYSIHSQEPKEPHDLMFTIHKSTGTISVISSGLDREKVPEYRLTVQATDMDGEGSTTTAEAVVQILDANDNAPEFEPQKYEAWVPENEVGHEVQRLTVTDLDVPNSPAWRATYHIVGGDDGDHFTITTHPETNQGVLTTKKGLDFEAQDQHTLYVEVTNEAPFAVKLPTATATVVVHVKDVNEAPVFVPPSKVIEAQEGISIGELVCIYTAQDPDKEDQKISYTISRDPANWLAVDPDSGQITAAGILDREDEQFVKNNVYEVMVLATDSGNPPTTGTGTLLLTLTDINDHGPIPEPRQIIICNQSPVPQVLNITDKDLSPNSSPFQAQLTHDSDIYWMAEVSEKGDTVALSLKKFLKQDTYDLHLSLSDHGNREQLTMIRATVCDCHGQVFNDCPRPWKGG

SEQ ID NO: 12 - DNA, 1644 bp, Mus musculus
  MISC_FEATURE: Murine CDH3 ECD
gagtgggtgatgccaccaatattcgtccccgagaatggcaagggtcccttccctcagaggctgaatcagctcaaatctaataaggacagaggcaccaagattttctacagcatcacagggcctggcgcagacagtccccccgaaggagtcttcaccatagagaaggagtcgggctggctgttgttgcatatgccactggacagggagaagattgtcaagtacgagctttatggccacgctgtatctgagaatggtgcctctgtagaggagcccatgaacatatccatcattgtgacagaccagaatgacaacaagcccaagttcactcaagacaccttcagagggagtgttctggagggagtaatgcctggcacttctgtgatgcaggtgacagccacagatgaggacgatgctgtcaacacttacaatggggtggtggcttactccatccatagccaagagccgaaggagccacacgacctcatgttcaccatccataaaagcacgggaaccattagcgtcatatccagtggcctggaccgagagaaagtccctgagtacagactgaccgtccaggccacagacatggatggagagggctctaccacgacggcagaggccgttgtgcaaatccttgatgccaacgataacgctcccgagtttgagccgcagaagtatgaggcttgggtgcctgagaacgaagtgggccatgaggtacagaggctgacagtgactgatctcgatgtccccaactcgccagcgtggcgtgccacctaccacatcgtgggaggtgatgatggggaccatttcaccatcaccactcacccagagaccaaccaaggcgtcctgacaaccaagaagggtttggattttgaggctcaggaccaacacaccctgtatgtagaagtgaccaacgaggctccctttgcagtgaagctcccgacagccactgccaccgtggtggtccatgtgaaagatgtcaacgaagcccctgtgtttgttccaccttccaaggtcattgaggcccaggaaggcatctctattggggaactggtctgcatctataccgcacaggacccagacaaggaggaccagaagatcagctacaccatctcgagagatccagccaactggcttgctgtggacccagacagtggtcagataactgccgcaggcatcttggatcgtgaggacgagcagtttgtgaaaaacaatgtctacgaagtcatggttttggccacagacagtggaaaccctcccaccaccggcactgggaccctcctgcttacacttactgacatcaacgaccatggcccgatccctgaacccaggcagatcatcatctgtaaccaaagccctgtgcctcaagtgctgaacatcactgacaaggacctgtcccccaactcctcccctttccaggcccagctaacacatgactcagatatctactggatggcagaagtcagcgagaaaggagacaccgtggccttgtccctgaagaagttcctgaaacaagacacgtatgacttgcatctttctttgtctgaccatggcaacagggaacagctaaccatgatcagggccactgtgtgtgactgccatggccaagtgttcaatgactgccccagaccctggaagggtggt

SEQ ID NO: 13 - protein, 710 aa, Homo sapiens
  MISC_FEATURE: Hu CDH3 Dom1 mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKREWVMPPIFVPENGKGPFPQRLNQLKSNKDRGTKIFYSITGPGADSPPEGVFTIEKESGWLLLHMPLDREKIVKYELYGHAVSENGASVEEPMNISIIVTDQNDNKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 14 - protein, 710 aa, Homo sapiens
  MISC_FEATURE: Hu CDH3 Dom1A mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKREWVMPPIFVPENGKGPFPQRLNQLKSNKDRGTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 15 - protein, 710 aa, Homo sapiens
  MISC_FEATURE: Hu CDH3 Dom1B mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFTIEKESGWLLLHMPLDREKIVKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 16 - protein, 710 aa, Homo sapiens
  MISC_FEATURE: Hu CDH3 Dom1C mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELYGHAVSENGASVEEPMNISIIVTDQNDNKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 17 - protein, 710 aa, Homo sapiens
  MISC_FEATURE: Hu CDH3 Dom2 mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVMPGTSVMQVTATDEDDAVNTYNGVVAYSIHSQEPKEPHDLMFTIHKSTGTISVISSGLDREKVPEYRLTVQATDMDGEGSTTTAEAVVQILDANDNAPEFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 18 - protein, 710 aa, Homo sapiens
  MISC_FEATURE: Hu CDH3 Dom2A mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVMPGTSVMQVTATDEDDAVNTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 19 - protein, 710 aa, Homo sapiens
  MISC_FEATURE: Hu CDH3 Dom2B mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKEPHDLMFTIHKSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 20 - protein, 710 aa, Homo sapiens
  MISC_FEATURE: Hu CDH3 Dom2C mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYRLTVQATDMDGEGSTTTAEAVVQILDANDNAPEFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 21 - protein, 710 aa, Homo sapiens
  MISC_FEATURE: Hu CDH3 Dom3 mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFEPQKYEAWVPENEVGHEVQRLTVTDLDVPNSPAWRATYHIVGGDDGDHFTITTHPETNQGVLTTKKGLDFEAQDQHTLYVEVTNEAPFAVKLPTATATVVVHVKDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 22 - protein, 710 aa, Homo sapiens
  MISC_FEATURE: Hu CDH3 Dom3A mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFEPQKYEAWVPENEVGHEVQRLTVTDLDVPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 23 - protein, 710 aa, Homo sapiens
  MISC_FEATURE: Hu CDH3 Dom3B mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYHIVGGDDGDHFTITTHPETNQGVLTTKKGLDFEAQDQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 24 - protein, 710 aa, Homo sapiens
  MISC_FEATURE: Hu CDH3 Dom3C mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFAVKLPTATATVVVHVKDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 25 - protein, 710 aa, Homo sapiens
  MISC_FEATURE: Hu CDH3 Dom4 mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVIEAQEGISIGELVCIYTAQDPDKEDQKISYTISRDPANWLAVDPDSGQITAAGILDREDEQFVKNNVYEVMVLATDSGNPPTTGTGTLLLTLTDINDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 26 - protein, 710 aa, Homo sapiens
  MISC_FEATURE: Hu CDH3 Dom4A mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVIEAQEGISIGELVCIYTAQDPDKEDQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 27 - protein, 710 aa, Homo sapiens
  MISC_FEATURE: Hu CDH3 Dom4B mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYTISRDPANWLAVDPDSGQITAAGILDREDEQFVKNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 28 - protein, 710 aa, Homo sapiens
  MISC_FEATURE: Hu CDH3 Dom4C mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNVYEVMVLATDSGNPPTTGTGTLLLTLTDINDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 29 - protein, 711 aa, Homo sapiens
  MISC_FEATURE: Hu CDH3 Dom5 mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPIPEPRQIIICNQSPVPQVLNITDKDLSPNSSPFQAQLTHDSDIYWMAEVSEKGDTVALSLKKFLKQDTYDLHLSLSDHGNREQLTMIRATVCDCHGQVFNDCPRPWKGGSGGGGSGAGVIAVIVVVVIAIVAGIVVLVISRKKRMAKYEKAEIKEMGEMHRELNA

SEQ ID NO: 30 - protein, 710 aa, Homo sapiens
  MISC_FEATURE: Hu CDH3 Dom5A mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPIPEPRQIIICNQSPVPQVLNITDKDLSPNSSPFQAQLTDDSDIYWTAEVNEEGDTVVLSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 31 - protein, 710 aa, Homo sapiens
  MISC_FEATURE: Hu CDH3 Dom5B mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTHDSDIYWMAEVSEKGDTVALSLKKFLKQDTYDVHLSLSDHGNKEQLTVIRATVCDCHGHVETCPGPWKGGSGGGGSGAGVIAVIVVVVIAIVAGIVVLVISRKKRMAKYEKAEIKEMGEMHRELNA

SEQ ID NO: 32 - protein, 711 aa, Homo sapiens
  MISC_FEATURE: Hu CDH3 Dom5C mu
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDLHLSLSDHGNREQLTMIRATVCDCHGQVFNDCPRPWKGGSGGGGSGAGVIAVIVVVVIAIVAGIVVLVISRKKRMAKYEKAEIKEMGEMHRELNA

SEQ ID NO: 33 - protein, 36 aa, Homo sapiens
  MISC_FEATURE: Human epitope cluster D1B
SITGPGADSPPEGVFAVEKETGWLLLNKPLDREEIA

SEQ ID NO: 34 - protein, 37 aa, Homo sapiens
  MISC_FEATURE: Human epitope cluster D2C
VPEYTLTIQATDMDGDGSTTTAVAVVEILDANDNAPM

SEQ ID NO: 35 - protein, 36 aa, Homo sapiens
  MISC_FEATURE: Human epitope cluster D3A
FDPQKYEAHVPENAVGHEVQRLTVTDLDAPNSPAWR

SEQ ID NO: 36 - protein, 73 aa, Homo sapiens
  MISC_FEATURE: Human epitope clusters D2C+D3A
VPEYTLTIQATDMDGDGSTTTAVAVVEILDANDNAPMFDPQKYEAHVPENAVGHEVQRLTVTDLDAPNSPAWR

SEQ ID NO: 37 - protein, 36 aa, Macaca fascicularis; identical to SEQ ID NO: 33
  MISC_FEATURE: Macaque epitope cluster D1B

SEQ ID NO: 38 - protein, 37 aa, Macaca fascicularis
  MISC_FEATURE: Macaque epitope cluster D2C
VPEYTLTIQATDMDGDGSTTTAVAVVEILDANDNAPV

SEQ ID NO: 39 - protein, 36 aa, Macaca fascicularis
  MISC_FEATURE: Macaque epitope cluster D3A
FDPQKYESHVPENAVGHEVQRLTVTDLDAPNSPAWR

SEQ ID NO: 40 - protein, 73 aa, Macaca fascicularis
  MISC_FEATURE: Macaque epitope clusters D2C+D3A
VPEYTLTIQATDMDGDGSTTTAVAVVEILDANDNAPVFDPQKYESHVPENAVGHEVQRLTVTDLDAPNSPAWR

SEQ ID NO: 41 - protein, 882 aa, Homo sapiens
  MISC_FEATURE: Human CDH1
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 42 - protein, 906 aa, Homo sapiens
  MISC_FEATURE: Human CDH2
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 43 - protein, 916 aa, Homo sapiens
  MISC_FEATURE: Human CDH4
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 44 - protein, 784 aa, Homo sapiens
  MISC_FEATURE: Human CDH5
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 45 - protein, 830 aa, Macaca fascicularis
  MISC_FEATURE: Macaque CDH1
MGPWSRSLSALLLLLQVSSWLCQEPEPCHPGFDAESYTFTVPRRHLERGRVLGRVSFEDCTGRQRTAYFSLDTRFKVGPDGVITVKRPLQFHNPQIHFLVYAWDSTYRKFSTKVTLNTVGHHSRTPPLHASVSGVQAELLTFPNSSPGLRRWKRDWVIPPISCPENEKGPFPKNLVQIKSNKDKEGKVFYSITGQGADTPPVGVFIIERETGWLKVTEPLDRENIATYTLFSHAVSSNGNAVEDPMEILITVTDQNDNKPVFTQEVFKGSVMEGALPGTSVMEVTATDADDDVNTYNAAIAYSILSQDPELPDKNMFTINKNTGVISVVTTGLDRESFPMYTLVVQAADLQGEGLSTTATAVITVTDTNDNPPVFNPTTYKGQVPENQANFVITTLKVTDADAPNTPAWEAVYTILNDNDGQFVVTTNPVTNDGILKTAKGLDFEAKQQYILHVAVTNVAPFEVSLTTSTATVTVDVLDVNEAPIFVPPEKRVEVSEDFGVGQEITSYTAREPDTFMEQKITYRIWRDAANWLEINPDTGAISTRAELDREDVEHVKNSTYTALIIATDNDHHLCDFLESHFLDEEVKLIKKIAQESIILKPKIALEVGDYKINLKLMDNQKKDQVTTLEVSVCDCEGAAGICKKAPLVEAGMQIPAILGILGGILALLILILLLLLFLRRRAVVKEPLLPPEDDTRDNVYYYDEEGGGEEDQDFDLSQLHRGLDARPEVTRNDVAPTLLSVPRYLPRPANPDEIGNFIDENLKAADSDPTAPPYDSLLVFDYEGSGSEAASLSSLNSSESDKDQDYDYLNEWGNRFKKLADMYGGGEDD

SEQ ID NO: 46 - protein, 906 aa, Macaca fascicularis
  MISC_FEATURE: Macaque CDH2
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPALTEESVKEPPEVEEIVFPRQLSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRILSQAPSTPSPNMFTINNETGDIITVAAGLDREKVQQYTLIIQATDMEGNPTYGLSNTATAIITVTDVNDNPPEFTAMTFYGEVPENRVDVIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 47 - protein, 917 aa, Macaca fascicularis
  MISC_FEATURE: Macaque CDH4
MTAGAGVLLLLLSLSGALRAHNEDLTTRETCKAGFSEDDYTALISQNILEGEKLLQVKFSSCVGTKGTQYETNSVDFKVGSDGTVFATRELQVPSEQVAFTVTAWDSQTAERWDAVVRLLVAQTSSLHSGHKPQKGKKIVALDPSPPPKDTLLPWPRHQNADGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGEAFSFSTRLSSPNTTTAPGNGDSHHVVTRRPRGGQGLGTQTCAAGDIVSLSRGMSREAKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISVMDINEAPYFPSNHKLIRLEEGVPPGTVLTTFSAVDPDRFMQQAVRYSKLSDPANWLHINTTNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPVRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 48 - protein, 785 aa, Macaca fascicularis
  MISC_FEATURE: Macaque CDH5
MQRLMMLVATSGACLGLLAAAAAAAAAGANPAQRDTPSLLPTHRRQKRDWIWNQMHIDEEKNTSLPHHVGKIKSSVSRKNAKYLLKGEFVDKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIVTITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPTHNEGIIKPMKPLDYEYIQQYSFIVEATDPTIDLRYLSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAQPYQPKVCENAAHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLSILTITVIALLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 49 - protein, 5 aa, Artificial Sequence
  Synthetic peptide
  MISC_FEATURE: CDH3-1 VH CDR1
SYAMS

SEQ ID NO: 50 - protein, 17 aa, Artificial Sequence
  Synthetic peptide
  MISC_FEATURE: CDH3-1 VH CDR2
TISSGGHYTYYPDSVKG

SEQ ID NO: 51 - protein, 9 aa, Artificial Sequence
  Synthetic peptide
  MISC_FEATURE: CDH3-1 VH CDR3
YYYGIPFGY

SEQ ID NO: 52 - protein, 11 aa, Artificial Sequence
  Synthetic peptide
  MISC_FEATURE: CDH3-1 VL CDR1
RASQDIGINLI

SEQ ID NO: 53 - protein, 7 aa, Artificial Sequence
  Synthetic peptide
  MISC_FEATURE: CDH3-1 VL CDR2
DTSSLDS

SEQ ID NO: 54 - protein, 9 aa, Artificial Sequence
  Synthetic peptide
  MISC_FEATURE: CDH3-1 VL CDR3
LQYGSSPLT

SEQ ID NO: 55 - protein, 118 aa, Artificial Sequence
  Synthetic peptide
  MISC_FEATURE: CDH3-1 VH
EVQLLESGGGLVQPGGSLRLSCAASGFTFSSYAMSWVRQAPGKGLEWVSTISSGGHYTYYPDSVKGRFTISRDNAKNTLYLQMNSLRAEDTAVYYCASYYYGIPFGYWGQGTLVTVSS

SEQ ID NO: 56 - protein, 107 aa, Artificial Sequence
  Synthetic peptide
  MISC_FEATURE: CDH3-1 VL
DIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIK

SEQ ID NO: 57 - protein, 240 aa, Artificial Sequence
  Synthetic peptide
  MISC_FEATURE: CDH3-1 scFv
EVQLLESGGGLVQPGGSLRLSCAASGFTFSSYAMSWVRQAPGKGLEWVSTISSGGHYTYYPDSVKGRFTISRDNAKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIK

SEQ ID NO: 58 - protein, 495 aa, Artificial Sequence
  Synthetic peptide
  MISC_FEATURE: CDH3-1 bispecific molecule
EVQLLESGGGLVQPGGSLRLSCAASGFTFSSYAMSWVRQAPGKGLEWVSTISSGGHYTYYPDSVKGRFTISRDNAKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 59 - protein, 5 aa, Artificial Sequence
  Synthetic peptide
  MISC_FEATURE: CDH3-2 VH CDR1
SYAMS

SEQ ID NO: 60 - protein, 17 aa, Artificial Sequence
  Synthetic peptide
  MISC_FEATURE: CDH3-2 VH CDR2
TISSGGHYTYYPDSVKG

SEQ ID NO: 61 - protein, 9 aa, Artificial Sequence
  Synthetic peptide
  MISC_FEATURE: CDH3-2 VH CDR3
YYYGIPFGY

SEQ ID NO: 62 - protein, 11 aa, Artificial Sequence
  Synthetic peptide
  MISC_FEATURE: CDH3-2 VL CDR1
RASQDIGINLI

SEQ ID NO: 63 - protein, 7 aa, Artificial Sequence
  Synthetic peptide
  MISC_FEATURE: CDH3-2 VL CDR2
DTSSLDS

SEQ ID NO: 64 - protein, 9 aa, Artificial Sequence
  Synthetic peptide
  MISC_FEATURE: CDH3-2 VL CDR3
LQYGSSPLT

SEQ ID NO: 65 - protein, 118 aa, Artificial Sequence
  Synthetic peptide
  MISC_FEATURE: CDH3-2 VH
EVQLLESGGGLVKPGGSLRLSCAASGFTFSSYAMSWVRQAPGKGLEWVATISSGGHYTYYPDSVKGRFTISRDNSKNTLYLQMNSLRAEDTAVYYCASYYYGIPFGYWGQGTLVTVSS

SEQ ID NO: 66 - protein, 107 aa, Artificial Sequence; identical to SEQ ID NO: 56
  Synthetic peptide
  MISC_FEATURE: CDH3-2 VL

SEQ ID NO: 67 - protein, 240 aa, Artificial Sequence
  Synthetic peptide
  MISC_FEATURE: CDH3-2 scFv
EVQLLESGGGLVKPGGSLRLSCAASGFTFSSYAMSWVRQAPGKGLEWVATISSGGHYTYYPDSVKGRFTISRDNSKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIK

SEQ ID NO: 68 - protein, 495 aa, Artificial Sequence
  Synthetic peptide
  MISC_FEATURE: CDH3-2 bispecific molecule
EVQLLESGGGLVKPGGSLRLSCAASGFTFSSYAMSWVRQAPGKGLEWVATISSGGHYTYYPDSVKGRFTISRDNSKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 69 - protein, 5 aa, Artificial Sequence
  Synthetic peptide
  MISC_FEATURE: CDH3-3 VH CDR1
SYAMS

SEQ ID NO: 70 - protein, 17 aa, Artificial Sequence
  Synthetic peptide
  MISC_FEATURE: CDH3-3 VH CDR2
TISSGGHYTYYPDSVKG

SEQ ID NO: 71 - protein, 9 aa, Artificial Sequence
  Synthetic peptide
  MISC_FEATURE: CDH3-3 VH CDR3
YYYGIPFGY

SEQ ID NO: 72 - protein, 11 aa, Artificial Sequence
  Synthetic peptide
  MISC_FEATURE: CDH3-3 VL CDR1
RASQDIGINLI

SEQ ID NO: 73 - protein, 7 aa, Artificial Sequence
  Synthetic peptide
  MISC_FEATURE: CDH3-3 VL CDR2
DTSSLDS

SEQ ID NO: 74 - protein, 9 aa, Artificial Sequence
  Synthetic peptide
  MISC_FEATURE: CDH3-3 VL CDR3
LQYGSSPLT

SEQ ID NO: 75 - protein, 118 aa, Artificial Sequence; identical to SEQ ID NO: 65
  Synthetic peptide
  MISC_FEATURE: CDH3-3 VH

SEQ ID NO: 76 - protein, 107 aa, Artificial Sequence; identical to SEQ ID NO: 56
  Synthetic peptide
  MISC_FEATURE: CDH3-3 VL

SEQ ID NO: 77 - protein, 240 aa, Artificial Sequence; identical to SEQ ID NO: 67
  Synthetic peptide
  MISC_FEATURE: CDH3-3 scFv

SEQ ID NO: 78 - protein, 495 aa, Artificial Sequence
  Synthetic peptide
  MISC_FEATURE: CDH3-3 bispecific molecule
EVQLLESGGGLVKPGGSLRLSCAASGFTFSSYAMSWVRQAPGKGLEWVATISSGGHYTYYPDSVKGRFTISRDNSKNTLYLQMNSLRAEDTAVYYCASYYYGIPFGYWGQGTLVTVSSGGGGSGGGGSGGGGSDIQMTQSPSTLSASLGDRVTITCRASQDIGINLIWLQQKPGKAPKRLIYDTSSLDSGVPSRFSGSGSGTEFTLTISSLQPDDFATYYCLQYGSSPLTFGGGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 79 - protein, 5 aa, Artificial Sequence
  Synthetic peptide
  MISC_FEATURE: CDH3-4 VH CDR1
SSWMN

SEQ ID NO: 80 - protein, 17 aa, Artificial Sequence
  Synthetic peptide
  MISC_FEATURE: CDH3-4 VH CDR2
RIYPGDGETKYADSVKG

SEQ ID NO: 81 - protein, 12 aa, Artificial Sequence
  Synthetic peptide
  MISC_FEATURE: CDH3-4 VH CDR3
QRDYGALYAMDY

SEQ ID NO: 82 - protein, 11 aa, Artificial Sequence
  Synthetic peptide
  MISC_FEATURE: CDH3-4 VL CDR1
RVSDDIYSYLA

SEQ ID NO: 83 - protein, 7 aa, Artificial Sequence
  Synthetic peptide
  MISC_FEATURE: CDH3-4 VL CDR2
NAKTLAE

SEQ ID NO: 84 - protein, 9 aa, Artificial Sequence
  Synthetic peptide
  MISC_FEATURE: CDH3-4 VL CDR3
QNHYVTPFT

SEQ ID NO: 85 - protein, 121 aa, Artificial Sequence
  Synthetic peptide
  MISC_FEATURE: CDH3-4 VH
EVQLLESGGGLVQPGGSLRLSCAASGFTFSSSWMNWVRQAPGKGLEWVSRIYPGDGETKYADSVKGRFTISRDNSKNTLYLQMNSLRAEDTAVYYCAKQRDYGALYAMDYWGQGTLVTVSS

SEQ ID NO: 86 - protein, 107 aa, Artificial Sequence
  Synthetic peptide
  MISC_FEATURE: CDH3-4 VL
DIQLTQSPSFLSASVGDRVTITCRVSDDIYSYLAWYQQKPGKAPKLLIYNAKTLAEGVPSRFSGSGSGTEFTLTISSLQPEDFATYYCQNHYVTPFTFGQGTKLEIK

SEQ ID NO: 87 - protein, 243 aa, Artificial Sequence
  Synthetic peptide
  MISC_FEATURE: CDH3-4 scFv
EVQLLESGGGLVQPGGSLRLSCAASGFTFSSSWMNWVRQAPGKGLEWVSRIYPGDGETKYADSVKGRFTISRDNSKNTLYLQMNSLRAEDTAVYYCAKQRDYGALYAMDYWGQGTLVTVSSGGGGSGGGGSGGGGSDIQLTQSPSFLSASVGDRVTITCRVSDDIYSYLAWYQQKPGKAPKLLIYNAKTLAEGVPSRFSGSGSGTEFTLTISSLQPEDFATYYCQNHYVTPFTFGQGTKLEIK

SEQ ID NO: 88 - protein, 498 aa, Artificial Sequence
  Synthetic peptide
  MISC_FEATURE: CDH3-4 bispecific molecule
EVQLLESGGGLVQPGGSLRLSCAASGFTFSSSWMNWVRQAPGKGLEWVSRIYPGDGETKYADSVKGRFTISRDNSKNTLYLQMNSLRAEDTAVYYCAKQRDYGALYAMDYWGQGTLVTVSSGGGGSGGGGSGGGGSDIQLTQSPSFLSASVGDRVTITCRVSDDIYSYLAWYQQKPGKAPKLLIYNAKTLAEGVPSRFSGSGSGTEFTLTISSLQPEDFATYYCQNHYVTPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 89 - protein, 5 aa, Artificial Sequence
  Synthetic peptide
  MISC_FEATURE: CDH3-5 VH CDR1
TSWMN

SEQ ID NO: 90 - protein, 17 aa, Artificial Sequence
  Synthetic peptide
  MISC_FEATURE: CDH3-5 VH CDR2
RIYPGDGETKYNGKFKG

SEQ ID NO: 91 - protein, 12 aa, Artificial Sequence
  Synthetic peptide
  MISC_FEATURE: CDH3-5 VH CDR3
QRDYGALYALDY

SEQ ID NO: 92 - protein, 11 aa, Artificial Sequence
  Synthetic peptide
  MISC_FEATURE: CDH3-5 VL CDR1
RASENIYSYLA

SEQ ID NO: 93 - protein, 7 aa, Artificial Sequence
  Synthetic peptide
  MISC_FEATURE: CDH3-5 VL CDR2
NAKTLAE

SEQ ID NO: 94 - protein, 9 aa, Artificial Sequence
  Synthetic peptide
  MISC_FEATURE: CDH3-5 VL CDR3
QHHYVPPYT

SEQ ID NO: 95 - protein, 122 aa, Artificial Sequence
  Synthetic peptide
  MISC_FEATURE: CDH3-5 VH
EVQLVEQSGAELVKPGASVKISCKASGYAFSTSWMNWVKQRPGKGLEWIGRIYPGDGETKYNGKFKGKATLTADKSSSTAYMQLSSLTSEDSAVYFCARQRDYGALYALDYWGQGTRVTVSS

SEQ ID NO: 96 - protein, 107 aa, Artificial Sequence
  Synthetic peptide
  MISC_FEATURE: CDH3-5 VL
ELMMTQTPASLSASVGETVTFTCRASENIYSYLAWYQQKQGKSPQLLVYNAKTLAEGVPSRFSGSGSGTQFSLKINSLQPEDFGSYYCQHHYVPPYTFGGGTKLEIK

SEQ ID NO: 97 - protein, 244 aa, Artificial Sequence
  Synthetic peptide
  MISC_FEATURE: CDH3-5 scFv
EVQLVEQSGAELVKPGASVKISCKASGYAFSTSWMNWVKQRPGKGLEWIGRIYPGDGETKYNGKFKGKATLTADKSSSTAYMQLSSLTSEDSAVYFCARQRDYGALYALDYWGQGTRVTVSSGGGGSGGGGSGGGGSELMMTQTPASLSASVGETVTFTCRASENIYSYLAWYQQKQGKSPQLLVYNAKTLAEGVPSRFSGSGSGTQFSLKINSLQPEDFGSYYCQHHYVPPYTFGGGTKLEIK

SEQ ID NO: 98 - protein, 506 aa, Artificial Sequence
  Synthetic peptide
  MISC_FEATURE: CDH3-5 bispecific molecule
EVQLVEQSGAELVKPGASVKISCKASGYAFSTSWMNWVKQRPGKGLEWIGRIYPGDGETKYNGKFKGKATLTADKSSSTAYMQLSSLTSEDSAVYFCARQRDYGALYALDYWGQGTRVTVSSGGGGSGGGGSGGGGSELMMTQTPASLSASVGETVTFTCRASENIYSYLAWYQQKQGKSPQLLVYNAKTLAEGVPSRFSGSGSGTQFSLKINSLQPEDFGSYYCQHHYVPPYTFGGGTKLEIKRTGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 99 - protein, 5 aa, Artificial Sequence
  Synthetic peptide
  MISC_FEATURE: CDH3-6 VH CDR1
SSWMN

SEQ ID NO: 100 - protein, 17 aa, Artificial Sequence
  Synthetic peptide
  MISC_FEATURE: CDH3-6 VH CDR2
RIYPGDGETKYNGKFKG

SEQ ID NO: 101 - protein, 12 aa, Artificial Sequence
  Synthetic peptide
  MISC_FEATURE: CDH3-6 VH CDR3
QRDYGALYAMDY

SEQ ID NO: 102 - protein, 11 aa, Artificial Sequence
  Synthetic peptide
  MISC_FEATURE: CDH3-6 VL CDR1
RASDDIYSYLA

SEQ ID NO: 103 - protein, 7 aa, Artificial Sequence
  Synthetic peptide
  MISC_FEATURE: CDH3-6 VL CDR2
NAKTLAE

SEQ ID NO: 104 - protein, 9 aa, Artificial Sequence
  Synthetic peptide
  MISC_FEATURE: CDH3-6 VL CDR3
QNHYVTPFT

SEQ ID NO: 105 - protein, 122 aa, Artificial Sequence
  Synthetic peptide
  MISC_FEATURE: CDH3-6 VH
EVQLVEESGPELVKPGASVKISCKASGYAFSSSWMNWVKQRPGKGLEWIGRIYPGDGETKYNGKFKGKATLTADKSSSTAYMQLSSLTSEDSAVYFCARQRDYGALYAMDYWGQGTSVTVSS

SEQ ID NO: 106 - protein, 107 aa, Artificial Sequence
  Synthetic peptide
  MISC_FEATURE: CDH3-6 VL
ELVMTQSPASLSASVGETVTITCRASDDIYSYLAWYQQKQGKSPQLLVYNAKTLAEGVPSRFSGSGSGTQFSLKINSLQPEDFGTYYCQNHYVTPFTFGAGTKLEIK

SEQ ID NO: 107 - protein, 244 aa, Artificial Sequence
  Synthetic peptide
  MISC_FEATURE: CDH3-6 scFv
EVQLVEESGPELVKPGASVKISCKASGYAFSSSWMNWVKQRPGKGLEWIGRIYPGDGETKYNGKFKGKATLTADKSSSTAYMQLSSLTSEDSAVYFCARQRDYGALYAMDYWGQGTSVTVSSGGGGSGGGGSGGGGSELVMTQSPASLSASVGETVTITCRASDDIYSYLAWYQQKQGKSPQLLVYNAKTLAEGVPSRFSGSGSGTQFSLKINSLQPEDFGTYYCQNHYVTPFTFGAGTKLEIK

SEQ ID NO: 108 - protein, 506 aa, Artificial Sequence
  Synthetic peptide
  MISC_FEATURE: CDH3-6 bispecific molecule
EVQLVEESGPELVKPGASVKISCKASGYAFSSSWMNWVKQRPGKGLEWIGRIYPGDGETKYNGKFKGKATLTADKSSSTAYMQLSSLTSEDSAVYFCARQRDYGALYAMDYWGQGTSVTVSSGGGGSGGGGSGGGGSELVMTQSPASLSASVGETVTITCRASDDIYSYLAWYQQKQGKSPQLLVYNAKTLAEGVPSRFSGSGSGTQFSLKINSLQPEDFGTYYCQNHYVTPFTFGAGTKLEIKRTGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 109 - protein, 5 aa, Artificial Sequence
  Synthetic peptide
  MISC_FEATURE: CDH3-7 VH CDR1
SSWMN

SEQ ID NO: 110 - protein, 17 aa, Artificial Sequence
  Synthetic peptide
  MISC_FEATURE: CDH3-7 VH CDR2
RIYPGDGETKYNGKFKG

SEQ ID NO: 111 - protein, 12 aa, Artificial Sequence
  Synthetic peptide
  MISC_FEATURE: CDH3-7 VH CDR3
QRDYGALYAMDY

SEQ ID NO: 112 - protein, 11 aa, Artificial Sequence
  Synthetic peptide
  MISC_FEATURE: CDH3-7 VL CDR1
RLSENIYSYLA

SEQ ID NO: 113 - protein, 7 aa, Artificial Sequence
  Synthetic peptide
  MISC_FEATURE: CDH3-7 VL CDR2
NSKTLAE

SEQ ID NO: 114 - protein, 9 aa, Artificial Sequence
  Synthetic peptide
  MISC_FEATURE: CDH3-7 VL CDR3
QNHYGFPFT

SEQ ID NO: 115 - protein, 122 aa, Artificial Sequence
  Synthetic peptide
  MISC_FEATURE: CDH3-7 VH
EVQLVEQSGAELVKPGASVKISCKASGYAFSSSWMNWVKQRPGKGLEWIGRIYPGDGETKYNGKFKGKATLTADKSSSTAYMQLSTLTSEDSAVYFCARQRDYGALYAMDYWGQGTSVTVSS

SEQ ID NO: 116 - protein, 107 aa, Artificial Sequence
  Synthetic peptide
  MISC_FEATURE: CDH3-7 VL
ELQMTQSPASLSASVGETVTITCRLSENIYSYLAWYRQKEGESPQLLVYNSKTLAEGVPSRFSGSGSGTQFSLKINSLQPEDFGNYYCQNHYGFPFTFGAGTKLEIK

SEQ ID NO: 117 - protein, 244 aa, Artificial Sequence
  Synthetic peptide
  MISC_FEATURE: CDH3-7 scFv
EVQLVEQSGAELVKPGASVKISCKASGYAFSSSWMNWVKQRPGKGLEWIGRIYPGDGETKYNGKFKGKATLTADKSSSTAYMQLSTLTSEDSAVYFCARQRDYGALYAMDYWGQGTSVTVSSGGGGSGGGGSGGGGSELQMTQSPASLSASVGETVTITCRLSENIYSYLAWYRQKEGESPQLLVYNSKTLAEGVPSRFSGSGSGTQFSLKINSLQPEDFGNYYCQNHYGFPFTFGAGTKLEIK

SEQ ID NO: 118 - protein, 506 aa, Artificial Sequence
  Synthetic peptide
  MISC_FEATURE: CDH3-7 bispecific molecule
EVQLVEQSGAELVKPGASVKISCKASGYAFSSSWMNWVKQRPGKGLEWIGRIYPGDGETKYNGKFKGKATLTADKSSSTAYMQLSTLTSEDSAVYFCARQRDYGALYAMDYWGQGTSVTVSSGGGGSGGGGSGGGGSELQMTQSPASLSASVGETVTITCRLSENIYSYLAWYRQKEGESPQLLVYNSKTLAEGVPSRFSGSGSGTQFSLKINSLQPEDFGNYYCQNHYGFPFTFGAGTKLEIKRTGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 119 - protein, 5 aa, Artificial Sequence
  Synthetic peptide
  MISC_FEATURE: CDH3-8 VH CDR1
SYWMN

SEQ ID NO: 120 - protein, 17 aa, Artificial Sequence
  Synthetic peptide
  MISC_FEATURE: CDH3-8 VH CDR2
HIYPGDGDTNYNGKFKG

SEQ ID NO: 121 - protein, 11 aa, Artificial Sequence
  Synthetic peptide
  MISC_FEATURE: CDH3-8 VH CDR3
DRGSFGAWFAY

SEQ ID NO: 122 - protein, 11 aa, Artificial Sequence
  Synthetic peptide
  MISC_FEATURE: CDH3-8 VL CDR1
RASQDISNYLN

SEQ ID NO: 123 - protein, 7 aa, Artificial Sequence
  Synthetic peptide
  MISC_FEATURE: CDH3-8 VL CDR2
YTSRLHS

SEQ ID NO: 124 - protein, 9 aa, Artificial Sequence
  Synthetic peptide
  MISC_FEATURE: CDH3-8 VL CDR3
QQGNRNPPT

SEQ ID NO: 125 - protein, 121 aa, Artificial Sequence
  Synthetic peptide
  MISC_FEATURE: CDH3-8 VH
EVQLVEQSGAEVVKPGASVKITCKASGYAFSSYWMNWVRQRPGKGLEWIGHIYPGDGDTNYNGKFKGKVTLTADKSSNTAYMQLSDLTPEDSAVYFCARDRGSFGAWFAYWGQGTTVTVSS

SEQ ID NO: 126 - protein, 107 aa, Artificial Sequence
  Synthetic peptide
  MISC_FEATURE: CDH3-8 VL
ELVMTQTPSSLSASLGDRVTISCRASQDISNYLNWYQQKPDGTVKLLIYYTSRLHSGVPSRFSGSGSGTDYSLTISNLEQEDIATYFCQQGNRNPPTFGGGTKLEIK

SEQ ID NO: 127 - protein, 243 aa, Artificial Sequence
  Synthetic peptide
  MISC_FEATURE: CDH3-8 scFv
EVQLVEQSGAEVVKPGASVKITCKASGYAFSSYWMNWVRQRPGKGLEWIGHIYPGDGDTNYNGKFKGKVTLTADKSSNTAYMQLSDLTPEDSAVYFCARDRGSFGAWFAYWGQGTTVTVSSGGGGSGGGGSGGGGSELVMTQTPSSLSASLGDRVTISCRASQDISNYLNWYQQKPDGTVKLLIYYTSRLHSGVPSRFSGSGSGTDYSLTISNLEQEDIATYFCQQGNRNPPTFGGGTKLEIK

SEQ ID NO: 128 - protein, 506 aa, Artificial Sequence
  Synthetic peptide
  MISC_FEATURE: CDH3-8 bispecific molecule
EVQLVEQSGAEVVKPGASVKITCKASGYAFSSYWMNWVRQRPGKGLEWIGHIYPGDGDTNYNGKFKGKVTLTADKSSNTAYMQLSDLTPEDSAVYFCARDRGSFGAWFAYWGQGTTVTVSSGGGGSGGGGSGGGGSELVMTQTPSSLSASLGDRVTISCRASQDISNYLNWYQQKPDGTVKLLIYYTSRLHSGVPSRFSGSGSGTDYSLTISNLEQEDIATYFCQQGNRNPPTFGGGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 129 - protein, 5 aa, Artificial Sequence
  Synthetic peptide
  MISC_FEATURE: CDH3-9 VH CDR1
TYGMS

SEQ ID NO: 130 - protein, 17 aa, Artificial Sequence
  Synthetic peptide
  MISC_FEATURE: CDH3-9 VH CDR2
TISSGGHYSYYPDSVKG

SEQ ID NO: 131 - protein, 9 aa, Artificial Sequence
  Synthetic peptide
  MISC_FEATURE: CDH3-9 VH CDR3
YYYGSPFAY

SEQ ID NO: 132 - protein, 11 aa, Artificial Sequence
  Synthetic peptide
  MISC_FEATURE: CDH3-9 VL CDR1
RASQDIGSSLN

SEQ ID NO: 133 - protein, 7 aa, Artificial Sequence
  Synthetic peptide
  MISC_FEATURE: CDH3-9 VL CDR2
DTSSLDS

SEQ ID NO: 134 - protein, 9 aa, Artificial Sequence
  Synthetic peptide
  MISC_FEATURE: CDH3-9 VL CDR3
VQYGSSPLT

SEQ ID NO: 135 - protein, 119 aa, Artificial Sequence
  Synthetic peptide
  MISC_FEATURE: CDH3-9 VH
EVQLVEESGGDLVKPGGSLKLSCAASGFTFSTYGMSWVRQTPDKRLEWVATISSGGHYSYYPDSVKGRFTISRDNAKNTLYLQMSSLKSEDTAMYYCASYYYGSPFAYWGQGTTVTVSS

SEQ ID NO: 136 - protein, 107 aa, Artificial Sequence
  Synthetic peptide
  MISC_FEATURE: CDH3-9 VL
ELQMTQSPSSLSASLGERVSLTCRASQDIGSSLNWLQQKPDGTIKRLIYDTSSLDSGVPKRFSGSRSGSDYSLTISSLESEDFGDYYCVQYGSSPLTFGAGTKLEIK

SEQ ID NO: 137 - protein, 241 aa, Artificial Sequence
  Synthetic peptide
  MISC_FEATURE: CDH3-9 scFv
EVQLVEESGGDLVKPGGSLKLSCAASGFTFSTYGMSWVRQTPDKRLEWVATISSGGHYSYYPDSVKGRFTISRDNAKNTLYLQMSSLKSEDTAMYYCASYYYGSPFAYWGQGTTVTVSSGGGGSGGGGSGGGGSELQMTQSPSSLSASLGERVSLTCRASQDIGSSLNWLQQKPDGTIKRLIYDTSSLDSGVPKRFSGSRSGSDYSLTISSLESEDFGDYYCVQYGSSPLTFGAGTKLEIK

SEQ ID NO: 138 - protein, 504 aa, Artificial Sequence
  Synthetic peptide
  MISC_FEATURE: CDH3-9 bispecific molecule
EVQLVEESGGDLVKPGGSLKLSCAASGFTFSTYGMSWVRQTPDKRLEWVATISSGGHYSYYPDSVKGRFTISRDNAKNTLYLQMSSLKSEDTAMYYCASYYYGSPFAYWGQGTTVTVSSGGGGSGGGGSGGGGSELQMTQSPSSLSASLGERVSLTCRASQDIGSSLNWLQQKPDGTIKRLIYDTSSLDSGVPKRFSGSRSGSDYSLTISSLESEDFGDYYCVQYGSSPLTFGAGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 139 - protein, 5 aa, Artificial Sequence
  Synthetic peptide
  MISC_FEATURE: CDH3-10 VH CDR1
SYAMS

SEQ ID NO: 140 - protein, 17 aa, Artificial Sequence
  Synthetic peptide
  MISC_FEATURE: CDH3-10 VH CDR2
TISSGGHYTYYPDSVKG

SEQ ID NO: 141 - protein, 9 aa, Artificial Sequence
  Synthetic peptide
  MISC_FEATURE: CDH3-10 VH CDR3
YYYGIPFGY

SEQ ID NO: 142 - protein, 11 aa, Artificial Sequence
  Synthetic peptide
  MISC_FEATURE: CDH3-10 VL CDR1
RASQDIGINLI

SEQ ID NO: 143 - protein, 7 aa, Artificial Sequence
  Synthetic peptide
  MISC_FEATURE: CDH3-10 VL CDR2
DTSSLDS

SEQ ID NO: 144 - protein, 9 aa, Artificial Sequence
  Synthetic peptide
  MISC_FEATURE: CDH3-10 VL CDR3
LQYGSSPLT

SEQ ID NO: 145 - protein, 119 aa, Artificial Sequence
  Synthetic peptide
  MISC_FEATURE: CDH3-10 VH
EVQLVEESGGGLVKPGGSLKLSCAASGFTFSSYAMSWVRQTPDKRLEWVATISSGGHYTYYPDSVKGRFTISRDNAKNTLYLQMSSLKSEDTAMYYCASYYYGIPFGYWGQGTTVTVSS

SEQ ID NO: 146 - protein, 107 aa, Artificial Sequence
  Synthetic peptide
  MISC_FEATURE: CDH3-10 VL
ELVMTQSPSSLSASLGEGVSLTCRASQDIGINLIWLRQEPDGTIKRLIYDTSSLDSGVPKRFSGSRSGSDYSLTISSLESEDFVHYYCLQYGSSPLTFGAGTKLEIK

SEQ ID NO: 147 - protein, 241 aa, Artificial Sequence
  Synthetic peptide
  MISC_FEATURE: CDH3-10 scFv
EVQLVEESGGGLVKPGGSLKLSCAASGFTFSSYAMSWVRQTPDKRLEWVATISSGGHYTYYPDSVKGRFTISRDNAKNTLYLQMSSLKSEDTAMYYCASYYYGIPFGYWGQGTTVTVSSGGGGSGGGGSGGGGSELVMTQSPSSLSASLGEGVSLTCRASQDIGINLIWLRQEPDGTIKRLIYDTSSLDSGVPKRFSGSRSGSDYSLTISSLESEDFVHYYCLQYGSSPLTFGAGTKLEIK

SEQ ID NO: 148 - protein, 504 aa, Artificial Sequence
  Synthetic peptide
  MISC_FEATURE: CDH3-10 scFv
EVQLVEESGGGLVKPGGSLKLSCAASGFTFSSYAMSWVRQTPDKRLEWVATISSGGHYTYYPDSVKGRFTISRDNAKNTLYLQMSSLKSEDTAMYYCASYYYGIPFGYWGQGTTVTVSSGGGGSGGGGSGGGGSELVMTQSPSSLSASLGEGVSLTCRASQDIGINLIWLRQEPDGTIKRLIYDTSSLDSGVPKRFSGSRSGSDYSLTISSLESEDFVHYYCLQYGSSPLTFGAGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 149 - protein, 5 aa, Artificial Sequence
  Synthetic peptide
  MISC_FEATURE: CDH3-11 VH CDR1
SYPIN

SEQ ID NO: 150 - protein, 16 aa, Artificial Sequence
  Synthetic peptide
  MISC_FEATURE: CDH3-11 VH CDR2
VIWTGGGTNYASSVKG

SEQ ID NO: 151 - protein, 15 aa, Artificial Sequence
  Synthetic peptide
  MISC_FEATURE: CDH3-11 VH CDR3
SRGVYDFDGRGAMDY

SEQ ID NO: 152 - protein, 17 aa, Artificial Sequence
  Synthetic peptide
  MISC_FEATURE: CDH3-11 VL CDR1
KSSQSLLYSSNQKNYLA

SEQ ID NO: 153 - protein, 7 aa, Artificial Sequence
  Synthetic peptide
  MISC_FEATURE: CDH3-11 VL CDR2
WASTRES

SEQ ID NO: 154 - protein, 9 aa, Artificial Sequence
  Synthetic peptide
  MISC_FEATURE: CDH3-11 VL CDR3
QQYYSYPYT

SEQ ID NO: 155 - protein, 123 aa, Artificial Sequence
  Synthetic peptide
  MISC_FEATURE: CDH3-11 VH
EVQLLESGGGLVQPGGSLRLSCAVSGFTLSSYPINWVRQAPGKGLEWVSVIWTGGGTNYASSVKGRFTISRDNSKNTLYLQMNSLRAEDTAVYYCAKSRGVYDFDGRGAMDYWGQGTLVTVSS

SEQ ID NO: 156 - protein, 113 aa, Artificial Sequence
  Synthetic peptide
  MISC_FEATURE: CDH3-11 VL
DIVMTQSPDSLAVSVGERVTINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 157 - protein, 251 aa, Artificial Sequence
  Synthetic peptide
  MISC_FEATURE: CDH3-11 scFv
EVQLLESGGGLVQPGGSLRLSCAVSGFTLSSYPINWVRQAPGKGLEWVSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSVGERVTINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 158 - protein, 506 aa, Artificial Sequence
  Synthetic peptide
  MISC_FEATURE: CDH3-11 bispecific molecule
EVQLLESGGGLVQPGGSLRLSCAVSGFTLSSYPINWVRQAPGKGLEWVSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSVGERVTINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 159 - protein, 5 aa, Artificial Sequence
  Synthetic peptide
  MISC_FEATURE: CDH3-12 VH CDR1
SYPIN

SEQ ID NO: 160 - protein, 16 aa, Artificial Sequence
  Synthetic peptide
  MISC_FEATURE: CDH3-12 VH CDR2
VIWTGGGTNYNPSLKS

SEQ ID NO: 161 - protein, 15 aa, Artificial Sequence
  Synthetic peptide
  MISC_FEATURE: CDH3-12 VH CDR3
SRGVYDFDGRGAMDY

SEQ ID NO: 162 - protein, 17 aa, Artificial Sequence
  Synthetic peptide
  MISC_FEATURE: CDH3-12 VL CDR1
KSSQSLLYSSNQKNYLA

SEQ ID NO: 163 - protein, 7 aa, Artificial Sequence
  Synthetic peptide
  MISC_FEATURE: CDH3-12 VL CDR2
WASTRES

SEQ ID NO: 164 - protein, 9 aa, Artificial Sequence
  Synthetic peptide
  MISC_FEATURE: CDH3-12 VL CDR3
QQYYSYPYT

SEQ ID NO: 165 - protein, 123 aa, Artificial Sequence
  Synthetic peptide
  MISC_FEATURE: CDH3-12 VH
QVQLQESGPGLVKPSETLSLTCTVSGVSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSS

SEQ ID NO: 166 - protein, 113 aa, Artificial Sequence
  Synthetic peptide
  MISC_FEATURE: CDH3-12 VL
DIVMTQSPASLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 167 - protein, 251 aa, Artificial Sequence
  Synthetic peptide
  MISC_FEATURE: CDH3-12 scFv
QVQLQESGPGLVKPSETLSLTCTVSGVSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPASLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 168 - protein, 506 aa, Artificial Sequence
  Synthetic peptide
  MISC_FEATURE: CDH3-12 bispecific molecule
QVQLQESGPGLVKPSETLSLTCTVSGVSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPASLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 169 - protein, 5 aa, Artificial Sequence
  Synthetic peptide
  MISC_FEATURE: CDH3-13 VH CDR1
SYPIN

SEQ ID NO: 170 - protein, 16 aa, Artificial Sequence
  Synthetic peptide
  MISC_FEATURE: CDH3-13 VH CDR2
VIWTGGGTNYASSVKG

SEQ ID NO: 171 - protein, 15 aa, Artificial Sequence
  Synthetic peptide
  MISC_FEATURE: CDH3-13 VH CDR3
SRGVYDFDGRGAMDY

SEQ ID NO: 172 - protein, 17 aa, Artificial Sequence
  Synthetic peptide
  MISC_FEATURE: CDH3-13 VL CDR1
KSSQSLLYSSNQKNYFA

SEQ ID NO: 173 - protein, 7 aa, Artificial Sequence
  Synthetic peptide
  MISC_FEATURE: CDH3-13 VL CDR2
WASTRES

SEQ ID NO: 174 - protein, 9 aa, Artificial Sequence
  Synthetic peptide
  MISC_FEATURE: CDH3-13 VL CDR3
QQYYSYPYT

SEQ ID NO: 175 - protein, 123 aa, Artificial Sequence
  Synthetic peptide
  MISC_FEATURE: CDH3-13 VH
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSS

SEQ ID NO: 176 - protein, 113 aa, Artificial Sequence
  Synthetic peptide
  MISC_FEATURE: CDH3-13 VL
DIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIK

SEQ ID NO: 177 - protein, 251 aa, Artificial Sequence
  Synthetic peptide
  MISC_FEATURE: CDH3-13 scFc
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIK

SEQ ID NO: 178 - protein, 506 aa, Artificial Sequence
  Synthetic peptide
  MISC_FEATURE: CDH3-13 bispecific molecule
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 179 - protein, 5 aa, Artificial Sequence
  Synthetic peptide
  MISC_FEATURE: CDH3-14 VH CDR1
SYPIN

SEQ ID NO: 180 - protein, 16 aa, Artificial Sequence
  Synthetic peptide
  MISC_FEATURE: CDH3-14 VH CDR2
VIWTGGGTNYNPSLKS

SEQ ID NO: 181 - protein, 15 aa, Artificial Sequence
  Synthetic peptide
  MISC_FEATURE: CDH3-14 VH CDR3
SRGVYDFDGRGAMDY

SEQ ID NO: 182 - protein, 17 aa, Artificial Sequence
  Synthetic peptide
  MISC_FEATURE: CDH3-14 VL CDR1
KSSQSLLYSSNQKNYLA

SEQ ID NO: 183 - protein, 7 aa, Artificial Sequence
  Synthetic peptide
  MISC_FEATURE: CDH3-14 VL CDR2
WASTRES

SEQ ID NO: 184 - protein, 9 aa, Artificial Sequence
  Synthetic peptide
  MISC_FEATURE: CDH3-14 VL CDR3
QQYYSYPYT

SEQ ID NO: 185 - protein, 123 aa, Artificial Sequence
  Synthetic peptide
  MISC_FEATURE: CDH3-14 VH
QVQLQESGPGLVKPSETLSLTCTVSGGSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSS

SEQ ID NO: 186 - protein, 113 aa, Artificial Sequence
  Synthetic peptide
  MISC_FEATURE: CDH3-14 VL
DIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 187 - protein, 251 aa, Artificial Sequence
  Synthetic peptide
  MISC_FEATURE: CDH3-14 scFv
QVQLQESGPGLVKPSETLSLTCTVSGGSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 188 - protein, 506 aa, Artificial Sequence
  Synthetic peptide
  MISC_FEATURE: CDH3-14 bispecific molecule
QVQLQESGPGLVKPSETLSLTCTVSGGSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 189 - protein, 5 aa, Artificial Sequence
  Synthetic peptide
  MISC_FEATURE: CDH3-15 VH CDR1
SYPIN

SEQ ID NO: 190 - protein, 16 aa, Artificial Sequence
  Synthetic peptide
  MISC_FEATURE: CDH3-15 VH CDR2
VIWTGGGTNYASSVKG

SEQ ID NO: 191 - protein, 15 aa, Artificial Sequence
  Synthetic peptide
  MISC_FEATURE: CDH3-15 VH CDR3
SRGVYDFDGRGAMDY

SEQ ID NO: 192 - protein, 17 aa, Artificial Sequence
  Synthetic peptide
  MISC_FEATURE: CDH3-15 VL CDR1
KSSQSLLYSSNQKNYLA

SEQ ID NO: 193 - protein, 7 aa, Artificial Sequence
  Synthetic peptide
  MISC_FEATURE: CDH3-15 VL CDR2
WASTRES

SEQ ID NO: 194 - protein, 9 aa, Artificial Sequence
  Synthetic peptide
  MISC_FEATURE: CDH3-15 VL CDR3
QQYYSYPYT

SEQ ID NO: 195 - protein, 123 aa, Artificial Sequence
  Synthetic peptide
  MISC_FEATURE: CDH3-15 VH
EVQLLESGGGLVQPGGSLRLSCAASGFTFSSYPINWVRQAPGKGLEWVSVIWTGGGTNYASSVKGRFTISRDNSKNTLYLQMNSLRAEDTAVYYCAKSRGVYDFDGRGAMDYWGQGTLVTVSS

SEQ ID NO: 196 - protein, 113 aa, Artificial Sequence
  Synthetic peptide
  MISC_FEATURE: CDH3-15 VL
DIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIK

SEQ ID NO: 197 - protein, 251 aa, Artificial Sequence
  Synthetic peptide
  MISC_FEATURE: CDH3-15 scFv
EVQLLESGGGLVQPGGSLRLSCAASGFTFSSYPINWVRQAPGKGLEWVSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIK

SEQ ID NO: 198 - protein, 506 aa, Artificial Sequence
  Synthetic peptide
  MISC_FEATURE: CDH3-15 bispecific molecule
EVQLLESGGGLVQPGGSLRLSCAASGFTFSSYPINWVRQAPGKGLEWVSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 199 - protein, 5 aa, Artificial Sequence
  Synthetic peptide
  MISC_FEATURE: CDH3-16 VH CDR1
SYPIN

SEQ ID NO: 200 - protein, 16 aa, Artificial Sequence
  Synthetic peptide
  MISC_FEATURE: CDH3-16 VH CDR2
VIWTGGGTNYNPSLKS

SEQ ID NO: 201 - protein, 15 aa, Artificial Sequence
  Synthetic peptide
  MISC_FEATURE: CDH3-16 VH CDR3
SRGVYDFDGRGAMDY

SEQ ID NO: 202 - protein, 17 aa, Artificial Sequence
  Synthetic peptide
  MISC_FEATURE: CDH3-16 VL CDR1
KSSQSLLYSSNQKNYLA

SEQ ID NO: 203 - protein, 7 aa, Artificial Sequence
  Synthetic peptide
  MISC_FEATURE: CDH3-16 VL CDR2
WASTRES

SEQ ID NO: 204 - protein, 9 aa, Artificial Sequence
  Synthetic peptide
  MISC_FEATURE: CDH3-16 VL CDR3
QQYYSYPYT

SEQ ID NO: 205 - protein, 123 aa, Artificial Sequence
  Synthetic peptide
  MISC_FEATURE: CDH3-16 VH
QVQLQESGPGLVKPSETLSLTCTVSGGSITSYPINWIRQPPGKGLEWIGVIWTGGGTNYNPSLKSRVTISVDTSKNQVSLKLSSVTAADTAVYYCARSRGVYDFDGRGAMDYWGQGTLVTVSS

SEQ ID NO: 206 - protein, 113 aa, Artificial Sequence; identical to SEQ ID NO: 186
  Synthetic peptide
  MISC_FEATURE: CDH3-16 VL

SEQ ID NO: 207 - protein, 251 aa, Artificial Sequence
  Synthetic peptide
  MISC_FEATURE: CDH3-16 scFv
QVQLQESGPGLVKPSETLSLTCTVSGGSITSYPINWIRQPPGKGLEWIGVIWTGGGTNYNPSLKSRVTISVDTSKNQVSLKLSSVTAADTAVYYCARSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 208 - protein, 506 aa, Artificial Sequence
  Synthetic peptide
  MISC_FEATURE: CDH3-16 bispecific molecule
QVQLQESGPGLVKPSETLSLTCTVSGGSITSYPINWIRQPPGKGLEWIGVIWTGGGTNYNPSLKSRVTISVDTSKNQVSLKLSSVTAADTAVYYCARSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 209 - protein, 5 aa, Artificial Sequence
  Synthetic peptide
  MISC_FEATURE: CDH3-17 VH CDR1
SYPIN

SEQ ID NO: 210 - protein, 16 aa, Artificial Sequence
  Synthetic peptide
  MISC_FEATURE: CDH3-17 VH CDR2
VIWTGGGTNYASSVKG

SEQ ID NO: 211 - protein, 15 aa, Artificial Sequence
  Synthetic peptide
  MISC_FEATURE: CDH3-17 VH CDR3
SRGVYDFDGRGAMDY

SEQ ID NO: 212 - protein, 17 aa, Artificial Sequence
  Synthetic peptide
  MISC_FEATURE: CDH3-17 VL CDR1
KSSQSLLYSSNQKNYLA

SEQ ID NO: 213 - protein, 7 aa, Artificial Sequence
  Synthetic peptide
  MISC_FEATURE: CDH3-17 VL CDR2
WASTRES

SEQ ID NO: 214 - protein, 9 aa, Artificial Sequence
  Synthetic peptide
  MISC_FEATURE: CDH3-17 VL CDR3
QQYYSYPYT

SEQ ID NO: 215 - protein, 123 aa, Artificial Sequence
  Synthetic peptide
  MISC_FEATURE: CDH3-17 VH
EVQLLESGGGLVPPGGSLRLSCAVSGFTFSSYPINWVRQAPGKGLEWVGVIWTGGGTNYASSVKGRFTISRDNSKNTLFLQMNSLRAEDTAVYYCAKSRGVYDFDGRGAMDYWGQGTLVTVSS

SEQ ID NO: 216 - protein, 113 aa, Artificial Sequence
  Synthetic peptide
  MISC_FEATURE: CDH3-17 VL
DIVMTQSPDSLAVSVGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 217 - protein, 251 aa, Artificial Sequence
  Synthetic peptide
  MISC_FEATURE: CDH3-17 scFv
EVQLLESGGGLVPPGGSLRLSCAVSGFTFSSYPINWVRQAPGKGLEWVGVIWTGGGTNYASSVKGRFTISRDNSKNTLFLQMNSLRAEDTAVYYCAKSRGVYDFDGRGAMDYWGQGTLVTVSSGGGGSGGGGSGGGGSDIVMTQSPDSLAVSVGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 218 - protein, 506 aa, Artificial Sequence
  Synthetic peptide
  MISC_FEATURE: CDH3-17 bispecific molecule
EVQLLESGGGLVPPGGSLRLSCAVSGFTFSSYPINWVRQAPGKGLEWVGVIWTGGGTNYASSVKGRFTISRDNSKNTLFLQMNSLRAEDTAVYYCAKSRGVYDFDGRGAMDYWGQGTLVTVSSGGGGSGGGGSGGGGSDIVMTQSPDSLAVSVGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 219 - protein, 5 aa, Artificial Sequence
  Synthetic peptide
  MISC_FEATURE: CDH3-18 VH CDR1
SYPIN

SEQ ID NO: 220 - protein, 16 aa, Artificial Sequence
  Synthetic peptide
  MISC_FEATURE: CDH3-18 VH CDR2
VIWTGGGTNYASSVKG

SEQ ID NO: 221 - protein, 15 aa, Artificial Sequence
  Synthetic peptide
  MISC_FEATURE: CDH3-18 VH CDR3
SRGAYDFDGRGAMDY

SEQ ID NO: 222 - protein, 17 aa, Artificial Sequence
  Synthetic peptide
  MISC_FEATURE: CDH3-18 VL CDR1
KSSQSLLYSSNQKNYLA

SEQ ID NO: 223 - protein, 7 aa, Artificial Sequence
  Synthetic peptide
  MISC_FEATURE: CDH3-18 VL CDR2
WASTRES

SEQ ID NO: 224 - protein, 9 aa, Artificial Sequence
  Synthetic peptide
  MISC_FEATURE: CDH3-18 VL CDR3
QQYYSYPYT

SEQ ID NO: 225 - protein, 123 aa, Artificial Sequence
  Synthetic peptide
  MISC_FEATURE: CDH3-18 VH
EVQLLESGGGLVQPGGSLRLSCAASGFTFSSYPINWVRQAPGKGLEWVGVIWTGGGTNYASSVKGRFTISRDNSKNTLYLQMNSLRAEDTAVYYCAKSRGAYDFDGRGAMDYWGQGTLVTVSS

SEQ ID NO: 226 - protein, 113 aa, Artificial Sequence
  Synthetic peptide
  MISC_FEATURE: CDH3-18 VL
DIVMTQSPDSLAVSLGEKATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 227 - protein, 251 aa, Artificial Sequence
  Synthetic peptide
  MISC_FEATURE: CDH3-18 scFv
EVQLLESGGGLVQPGGSLRLSCAASGFTFSSYPINWVRQAPGKGLEWVGVIWTGGGTNYASSVKGRFTISRDNSKNTLYLQMNSLRAEDTAVYYCAKSRGAYDFDGRGAMDYWGQGTLVTVSSGGGGSGGGGSGGGGSDIVMTQSPDSLAVSLGEKATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 228 - protein, 506 aa, Artificial Sequence
  Synthetic peptide
  MISC_FEATURE: CDH3-18 bispecific molecule
EVQLLESGGGLVQPGGSLRLSCAASGFTFSSYPINWVRQAPGKGLEWVGVIWTGGGTNYASSVKGRFTISRDNSKNTLYLQMNSLRAEDTAVYYCAKSRGAYDFDGRGAMDYWGQGTLVTVSSGGGGSGGGGSGGGGSDIVMTQSPDSLAVSLGEKATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 229 - protein, 5 aa, Artificial Sequence
  Synthetic peptide
  MISC_FEATURE: CDH3-19 VH CDR1
SYPIN

SEQ ID NO: 230 - protein, 16 aa, Artificial Sequence
  Synthetic peptide
  MISC_FEATURE: CDH3-19 VH CDR2
VIWTGGGTNYASSVKG

SEQ ID NO: 231 - protein, 15 aa, Artificial Sequence
  Synthetic peptide
  MISC_FEATURE: CDH3-19 VH CDR3
SRGVYDFDGRGAMDY

SEQ ID NO: 232 - protein, 17 aa, Artificial Sequence
  Synthetic peptide
  MISC_FEATURE: CDH3-19 VL CDR1
KSSQSLLYSSNQKNYLA

SEQ ID NO: 233 - protein, 7 aa, Artificial Sequence
  Synthetic peptide
  MISC_FEATURE: CDH3-19 VL CDR2
WASTRES

SEQ ID NO: 234 - protein, 9 aa, Artificial Sequence
  Synthetic peptide
  MISC_FEATURE: CDH3-19 VL CDR3
QQYYSYPYT

SEQ ID NO: 235 - protein, 123 aa, Artificial Sequence
  Synthetic peptide
  MISC_FEATURE: CDH3-19 VH
EVQLLESGGGLVQPGGSLRLSCAASGFSFSSYPINWVRQAPGKGLEWLSVIWTGGGTNYASSVKGRFTISRDNSKNTLYLQMNSLRAEDTAVYYCAKSRGVYDFDGRGAMDYWGQGTLVTVSS

SEQ ID NO: 236 - protein, 113 aa, Artificial Sequence; identical to SEQ ID NO: 196
  Synthetic peptide
  MISC_FEATURE: CDH3-19 VL

SEQ ID NO: 237 - protein, 251 aa, Artificial Sequence
  Synthetic peptide
  MISC_FEATURE: CDH3-19 scFv
EVQLLESGGGLVQPGGSLRLSCAASGFSFSSYPINWVRQAPGKGLEWLSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIK

SEQ ID NO: 238 - protein, 506 aa, Artificial Sequence
  Synthetic peptide
  MISC_FEATURE: CDH3-19 bispecific molecule
EVQLLESGGGLVQPGGSLRLSCAASGFSFSSYPINWVRQAPGKGLEWLSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSVQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 239 - protein, 5 aa, Artificial Sequence
  Synthetic peptide
  MISC_FEATURE: CDH3-20 VH CDR1
SYPIN

SEQ ID NO: 240 - protein, 16 aa, Artificial Sequence
  Synthetic peptide
  MISC_FEATURE: CDH3-20 VH CDR2
VIWTGGGTNYADSVKG

SEQ ID NO: 241 - protein, 14 aa, Artificial Sequence
  Synthetic peptide
  MISC_FEATURE: CDH3-20 VH CDR3
RGVYDFDGRGAMDY

SEQ ID NO: 242 - protein, 17 aa, Artificial Sequence
  Synthetic peptide
  MISC_FEATURE: CDH3-20 VL CDR1
KSSQSLLYSSNQKNYLA

SEQ ID NO: 243 - protein, 7 aa, Artificial Sequence
  Synthetic peptide
  MISC_FEATURE: CDH3-20 VL CDR2
WASTRES

SEQ ID NO: 244 - protein, 9 aa, Artificial Sequence
  Synthetic peptide
  MISC_FEATURE: CDH3-20 VL CDR3
QQYYSYPYT

SEQ ID NO: 245 - protein, 122 aa, Artificial Sequence
  Synthetic peptide
  MISC_FEATURE: CDH3-20 VH
EVQLLESGGGLVQPGGSLRLSCAASGFTFSSYPINWVRQAPGKGLEWVSVIWTGGGTNYADSVKGRFTISRDNSKNTLYLQMNSLRAEDTAVYYCAKRGVYDFDGRGAMDYWGQGTLVTVSS

SEQ ID NO: 246 - protein, 113 aa, Artificial Sequence; identical to SEQ ID NO: 186
  Synthetic peptide
  MISC_FEATURE: CDH3-20 VL

SEQ ID NO: 247 - protein, 250 aa, Artificial Sequence
  Synthetic peptide
  MISC_FEATURE: CDH3-20 scFv
EVQLLESGGGLVQPGGSLRLSCAASGFTFSSYPINWVRQAPGKGLEWVSVIWTGGGTNYADSVKGRFTISRDNSKNTLYLQMNSLRAEDTAVYYCAKRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 248 - protein, 505 aa, Artificial Sequence
  Synthetic peptide
  MISC_FEATURE: CDH3-20 bispecific molecule
EVQLLESGGGLVQPGGSLRLSCAASGFTFSSYPINWVRQAPGKGLEWVSVIWTGGGTNYADSVKGRFTISRDNSKNTLYLQMNSLRAEDTAVYYCAKRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 249 - protein, 5 aa, Artificial Sequence
  Synthetic peptide
  MISC_FEATURE: CDH3-21 VH CDR1
SYPIN

SEQ ID NO: 250 - protein, 16 aa, Artificial Sequence
  Synthetic peptide
  MISC_FEATURE: CDH3-21 VH CDR2
VIWTGGGTNYNSALKS

SEQ ID NO: 251 - protein, 15 aa, Artificial Sequence
  Synthetic peptide
  MISC_FEATURE: CDH3-21 VH CDR3
SRGVYDFDGRGAMDY

SEQ ID NO: 252 - protein, 17 aa, Artificial Sequence
  Synthetic peptide
  MISC_FEATURE: CDH3-21 VL CDR1
KSSQSLLYSSNQKNYLA

SEQ ID NO: 253 - protein, 7 aa, Artificial Sequence
  Synthetic peptide
  MISC_FEATURE: CDH3-21 VL CDR2
WASTRES

SEQ ID NO: 254 - protein, 9 aa, Artificial Sequence
  Synthetic peptide
  MISC_FEATURE: CDH3-21 VL CDR3
QQYYSYPYT

SEQ ID NO: 255 - protein, 124 aa, Artificial Sequence
  Synthetic peptide
  MISC_FEATURE: CDH3-21 VH
EVQLLEESGPGLVTPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSS

SEQ ID NO: 256 - protein, 113 aa, Artificial Sequence
  Synthetic peptide
  MISC_FEATURE: CDH3-21 VL
ELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK

SEQ ID NO: 257 - protein, 252 aa, Artificial Sequence
  Synthetic peptide
  MISC_FEATURE: CDH3-21 scFv
EVQLLEESGPGLVTPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK

SEQ ID NO: 258 - protein, 515 aa, Artificial Sequence
  Synthetic peptide
  MISC_FEATURE: CDH3-21 bispecific molecule
EVQLLEESGPGLVTPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 259 - protein, 5 aa, Artificial Sequence
  Synthetic peptide
  MISC_FEATURE: CDH3-22 VH CDR1
SYPIN

SEQ ID NO: 260 - protein, 16 aa, Artificial Sequence
  Synthetic peptide
  MISC_FEATURE: CDH3-22 VH CDR2
VIWTGGGTNYNSALKS

SEQ ID NO: 261 - protein, 15 aa, Artificial Sequence
  Synthetic peptide
  MISC_FEATURE: CDH3-22 VH CDR3
SRGVYDFDGRGAMDY

SEQ ID NO: 262 - protein, 17 aa, Artificial Sequence
  Synthetic peptide
  MISC_FEATURE: CDH3-22 VL CDR1
KSSQSLLYSSNQKNYLA

SEQ ID NO: 263 - protein, 7 aa, Artificial Sequence
  Synthetic peptide
  MISC_FEATURE: CDH3-22 VL CDR2
WASTRES

SEQ ID NO: 264 - protein, 9 aa, Artificial Sequence
  Synthetic peptide
  MISC_FEATURE: CDH3-22 VL CDR3
QQYYSYPYT

SEQ ID NO: 265 - protein, 124 aa, Artificial Sequence
  Synthetic peptide
  MISC_FEATURE: CDH3-22 VH
EVQLLEESGPGLVAPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSS

SEQ ID NO: 266 - protein, 113 aa, Artificial Sequence; identical to SEQ ID NO: 256
  Synthetic peptide
  MISC_FEATURE: CDH3-22 VL

SEQ ID NO: 267 - protein, 252 aa, Artificial Sequence
  Synthetic peptide
  MISC_FEATURE: CDH3-22 scFv
EVQLLEESGPGLVAPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK

SEQ ID NO: 268 - protein, 515 aa, Artificial Sequence
  Synthetic peptide
  MISC_FEATURE: CDH3-22 bispecific molecule
EVQLLEESGPGLVAPSQSLSITCTVSGFSLTSYPINWVRQPPGKGLEWLGVIWTGGGTNYNSALKSRLSITKDNSKSQVFLKMTSLQTDDTARYYCAKSRGVYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 269 - protein, 5 aa, Artificial Sequence
  Synthetic peptide
  MISC_FEATURE: CDH3-23 VH CDR1
SYPIN

SEQ ID NO: 270 - protein, 16 aa, Artificial Sequence
  Synthetic peptide
  MISC_FEATURE: CDH3-23 VH CDR2
VIWTGGGTNYDSALKS

SEQ ID NO: 271 - protein, 15 aa, Artificial Sequence
  Synthetic peptide
  MISC_FEATURE: CDH3-23 VH CDR3
SRGAYDFDGRGAMDY

SEQ ID NO: 272 - protein, 17 aa, Artificial Sequence
  Synthetic peptide
  MISC_FEATURE: CDH3-23 VL CDR1
KSSQSLLYSSNQKNYLA

SEQ ID NO: 273 - protein, 7 aa, Artificial Sequence
  Synthetic peptide
  MISC_FEATURE: CDH3-23 VL CDR2
WASTRES

SEQ ID NO: 274 - protein, 9 aa, Artificial Sequence
  Synthetic peptide
  MISC_FEATURE: CDH3-23 VL CDR3
QQYYSYPYT

SEQ ID NO: 275 - protein, 124 aa, Artificial Sequence
  Synthetic peptide
  MISC_FEATURE: CDH3-23 VH
EVQLVEESGPGLVAPSQSLSITCTVSGFSLTSYPINWVRQPPGKGLEWLGVIWTGGGTNYDSALKSRLTISKDNSKSQVFLKMNSLQTDDTARYYCARSRGAYDFDGRGAMDYWGQGTTVTVSS

SEQ ID NO: 276 - protein, 113 aa, Artificial Sequence; identical to SEQ ID NO: 256
  Synthetic peptide
  MISC_FEATURE: CDH3-23 VL

SEQ ID NO: 277 - protein, 252 aa, Artificial Sequence
  Synthetic peptide
  MISC_FEATURE: CDH3-23 scFv
EVQLVEESGPGLVAPSQSLSITCTVSGFSLTSYPINWVRQPPGKGLEWLGVIWTGGGTNYDSALKSRLTISKDNSKSQVFLKMNSLQTDDTARYYCARSRGAYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK

SEQ ID NO: 278 - protein, 515 aa, Artificial Sequence
  Synthetic peptide
  MISC_FEATURE: CDH3-23 bispecific molecule
EVQLVEESGPGLVAPSQSLSITCTVSGFSLTSYPINWVRQPPGKGLEWLGVIWTGGGTNYDSALKSRLTISKDNSKSQVFLKMNSLQTDDTARYYCARSRGAYDFDGRGAMDYWGQGTTVTVSSGGGGSGGGGSGGGGSELVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 279 - protein, 5 aa, Artificial Sequence
  Synthetic peptide
  MISC_FEATURE: CDH3-24 VH CDR1
SYWMH

SEQ ID NO: 280 - protein, 17 aa, Artificial Sequence
  Synthetic peptide
  MISC_FEATURE: CDH3-24 VH CDR2
VIDTSDSYTIYNQKFQG

SEQ ID NO: 281 - protein, 8 aa, Artificial Sequence
  Synthetic peptide
  MISC_FEATURE: CDH3-24 VH CDR3
SGPGYFDV

SEQ ID NO: 282 - protein, 11 aa, Artificial Sequence
  Synthetic peptide
  MISC_FEATURE: CDH3-24 VL CDR1
RASGNIHNYLA

SEQ ID NO: 283 - protein, 7 aa, Artificial Sequence
  Synthetic peptide
  MISC_FEATURE: CDH3-24 VL CDR2
NAKTLAD

SEQ ID NO: 284 - protein, 9 aa, Artificial Sequence
  Synthetic peptide
  MISC_FEATURE: CDH3-24 VL CDR3
QHFWSTPYT

SEQ ID NO: 285 - protein, 117 aa, Artificial Sequence
  Synthetic peptide
  MISC_FEATURE: CDH3-24 VH
QVQLVQSGAEVKKPGASVKVSCKASGYTFTSYWMHWVRQAPGQGLEWMGVIDTSDSYTIYNQKFQGRVTMTRDTSTSTAYMELSSLRSEDTAVYYCARSGPGYFDVWGQGTMVTVSS

SEQ ID NO: 286 - protein, 107 aa, Artificial Sequence
  Synthetic peptide
  MISC_FEATURE: CDH3-24 VL
DIQLTQSPSFLSASVGDRVTITCRASGNIHNYLAWYQQKPGKAPKLLIYNAKTLADGVPSRFSGSGSGTEFTLKISSLQPEDFATYYCQHFWSTPYTFGQGTKLEIK

SEQ ID NO: 287 - protein, 239 aa, Artificial Sequence
  Synthetic peptide
  MISC_FEATURE: CDH3-24 scFv
QVQLVQSGAEVKKPGASVKVSCKASGYTFTSYWMHWVRQAPGQGLEWMGVIDTSDSYTIYNQKFQGRVTMTRDTSTSTAYMELSSLRSEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLKISSLQPEDFATYYCQHFWSTPYTFGQGTKLEIK

SEQ ID NO: 288 - protein, 494 aa, Artificial Sequence
  Synthetic peptide
  MISC_FEATURE: CDH3-24 bispecific molecule
QVQLVQSGAEVKKPGASVKVSCKASGYTFTSYWMHWVRQAPGQGLEWMGVIDTSDSYTIYNQKFQGRVTMTRDTSTSTAYMELSSLRSEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLKISSLQPEDFATYYCQHFWSTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 289 - protein, 5 aa, Artificial Sequence
  Synthetic peptide
  MISC_FEATURE: CDH3-25 VH CDR1
SYWMH

SEQ ID NO: 290 - protein, 17 aa, Artificial Sequence
  Synthetic peptide
  MISC_FEATURE: CDH3-25 VH CDR2
VIDTSDSYTIYNQKFKG

SEQ ID NO: 291 - protein, 8 aa, Artificial Sequence
  Synthetic peptide
  MISC_FEATURE: CDH3-25 VH CDR3
SGPGYFDV

SEQ ID NO: 292 - protein, 11 aa, Artificial Sequence
  Synthetic peptide
  MISC_FEATURE: CDH3-25 VL CDR1
RASENIYSYLA

SEQ ID NO: 293 - protein, 7 aa, Artificial Sequence
  Synthetic peptide
  MISC_FEATURE: CDH3-25 VL CDR2
NAKTLAE

SEQ ID NO: 294 - protein, 9 aa, Artificial Sequence
  Synthetic peptide
  MISC_FEATURE: CDH3-25 VL CDR3
QHHYGTPYT

SEQ ID NO: 295 - protein, 117 aa, Artificial Sequence
  Synthetic peptide
  MISC_FEATURE: CDH3-25 VH
QVQLVQSGAEVKKPGASVKVSCKASGYTFTSYWMHWVRQAPGQGLEWMGVIDTSDSYTIYNQKFKGRVTMTRDTSTSTVYMELSSLRSEDTAVYYCARSGPGYFDVWGQGTMVTVSS

SEQ ID NO: 296 - protein, 107 aa, Artificial Sequence
  Synthetic peptide
  MISC_FEATURE: CDH3-25 VL
DIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIK

SEQ ID NO: 297 - protein, 239 aa, Artificial Sequence
  Synthetic peptide
  MISC_FEATURE: CDH3-25 scFv
QVQLVQSGAEVKKPGASVKVSCKASGYTFTSYWMHWVRQAPGQGLEWMGVIDTSDSYTIYNQKFKGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIK

SEQ ID NO: 298 - protein, 494 aa, Artificial Sequence
  Synthetic peptide
  MISC_FEATURE: CDH3-25 bispecific molecule
QVQLVQSGAEVKKPGASVKVSCKASGYTFTSYWMHWVRQAPGQGLEWMGVIDTSDSYTIYNQKFKGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 299 - protein, 5 aa, Artificial Sequence
  Synthetic peptide
  MISC_FEATURE: CDH3-26 VH CDR1
SYWMH

SEQ ID NO: 300 - protein, 17 aa, Artificial Sequence
  Synthetic peptide
  MISC_FEATURE: CDH3-26 VH CDR2
VIDTSDSYTIYNQKFQG

SEQ ID NO: 301 - protein, 8 aa, Artificial Sequence
  Synthetic peptide
  MISC_FEATURE: CDH3-26 VH CDR3
SGPGYFDV

SEQ ID NO: 302 - protein, 11 aa, Artificial Sequence
  Synthetic peptide
  MISC_FEATURE: CDH3-26 VL CDR1
RASENIYSYLA

SEQ ID NO: 303 - protein, 7 aa, Artificial Sequence
  Synthetic peptide
  MISC_FEATURE: CDH3-26 VL CDR2
NAKTLAE

SEQ ID NO: 304 - protein, 9 aa, Artificial Sequence
  Synthetic peptide
  MISC_FEATURE: CDH3-26 VL CDR3
QHHYGTPYT

SEQ ID NO: 305 - protein, 117 aa, Artificial Sequence
  Synthetic peptide
  MISC_FEATURE: CDH3-26 VH
QVQLVQSGAEVKKPGASVKVSCKASGYTFTSYWMHWVRQAPGQGLEWMGVIDTSDSYTIYNQKFQGRVTMTRDTSTSTVYMELSSLRSEDTAVYYCARSGPGYFDVWGQGTMVTVSS

SEQ ID NO: 306 - protein, 107 aa, Artificial Sequence
  Synthetic peptide
  MISC_FEATURE: CDH3-26 VL
DIQLTQSPSFLSASVGDRVTITCRASENIYSYLAWYQQKPGKAPKLLVYNAKTLAEGVPSRFSGSGSGTEFTLTISSLQPEDFATYYCQHHYGTPYTFGQGTKLEIK

SEQ ID NO: 307 - protein, 239 aa, Artificial Sequence
  Synthetic peptide
  MISC_FEATURE: CDH3-26 scFv
QVQLVQSGAEVKKPGASVKVSCKASGYTFTSYWMHWVRQAPGQGLEWMGVIDTSDSYTIYNQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLVYNAKTLAEGVPSRFSGSGSGTEFTLTISSLQPEDFATYYCQHHYGTPYTFGQGTKLEIK

SEQ ID NO: 308 - protein, 494 aa, Artificial Sequence
  Synthetic peptide
  MISC_FEATURE: CDH3-26 bispecific molecule
QVQLVQSGAEVKKPGASVKVSCKASGYTFTSYWMHWVRQAPGQGLEWMGVIDTSDSYTIYNQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLVYNAKTLAEGVPSRFSGSGSGTEFTLTISSLQPEDFATYYCQHHYGTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 309 - protein, 5 aa, Artificial Sequence
  Synthetic peptide
  MISC_FEATURE: CDH3-27 VH CDR1
SYWMH

SEQ ID NO: 310 - protein, 17 aa, Artificial Sequence
  Synthetic peptide
  MISC_FEATURE: CDH3-27 VH CDR2
VIDTSDSYTIYAQKFQG

SEQ ID NO: 311 - protein, 8 aa, Artificial Sequence
  Synthetic peptide
  MISC_FEATURE: CDH3-27 VH CDR3
SGPGYFDV

SEQ ID NO: 312 - protein, 11 aa, Artificial Sequence
  Synthetic peptide
  MISC_FEATURE: CDH3-27 VL CDR1
RASENIYSYLA

SEQ ID NO: 313 - protein, 7 aa, Artificial Sequence
  Synthetic peptide
  MISC_FEATURE: CDH3-27 VL CDR2
NAKTLAE

SEQ ID NO: 314 - protein, 9 aa, Artificial Sequence
  Synthetic peptide
  MISC_FEATURE: CDH3-27 VL CDR3
QHHYGTPYT

SEQ ID NO: 315 - protein, 117 aa, Artificial Sequence
  Synthetic peptide
  MISC_FEATURE: CDH3-27 VH
QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSS

SEQ ID NO: 316 - protein, 107 aa, Artificial Sequence; identical to SEQ ID NO: 296
  Synthetic peptide
  MISC_FEATURE: CDH3-27 VL

SEQ ID NO: 317 - protein, 239 aa, Artificial Sequence
  Synthetic peptide
  MISC_FEATURE: CDH3-27 scFv
QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIK

SEQ ID NO: 318 - protein, 494 aa, Artificial Sequence
  Synthetic peptide
  MISC_FEATURE: CDH3-27 bispecific molecule
QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 319 - protein, 5 aa, Artificial Sequence
  Synthetic peptide
  MISC_FEATURE: CDH3-28 VH CDR1
SYWMH

SEQ ID NO: 320 - protein, 17 aa, Artificial Sequence
  Synthetic peptide
  MISC_FEATURE: CDH3-28 VH CDR2
VIDTSDSYTIYNQKVKG

SEQ ID NO: 321 - protein, 8 aa, Artificial Sequence
  Synthetic peptide
  MISC_FEATURE: CDH3-28 VH CDR3
SGPGYFDV

SEQ ID NO: 322 - protein, 11 aa, Artificial Sequence
  Synthetic peptide
  MISC_FEATURE: CDH3-28 VL CDR1
RASGNIHNYLA

SEQ ID NO: 323 - protein, 7 aa, Artificial Sequence
  Synthetic peptide
  MISC_FEATURE: CDH3-28 VL CDR2
NAKTLAD

SEQ ID NO: 324 - protein, 9 aa, Artificial Sequence
  Synthetic peptide
  MISC_FEATURE: CDH3-28 VL CDR3
QHSWSTPYT

SEQ ID NO: 325 - protein, 117 aa, Artificial Sequence
  Synthetic peptide
  MISC_FEATURE: CDH3-28 VH
EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSS

SEQ ID NO: 326 - protein, 107 aa, Artificial Sequence
  Synthetic peptide
  MISC_FEATURE: CDH3-28 VL
DIQLTQSPSFLSASVGDRVTITCRASGNIHNYLAWYQQKQGKAPKLLIYNAKTLADGVPSRFSGSGSGTEFTLTISSLQPEDFATYYCQHSWSTPYTFGQGTKLEIK

SEQ ID NO: 327 - protein, 239 aa, Artificial Sequence
  Synthetic peptide
  MISC_FEATURE: CDH3-28 scFv
EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKQGKAPKLLIYNAKTLADGVPSRFSGSGSGTEFTLTISSLQPEDFATYYCQHSWSTPYTFGQGTKLEIK

SEQ ID NO: 328 - protein, 494 aa, Artificial Sequence
  Synthetic peptide
  MISC_FEATURE: CDH3-28 bispecific molecule
EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKQGKAPKLLIYNAKTLADGVPSRFSGSGSGTEFTLTISSLQPEDFATYYCQHSWSTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 329 - protein, 5 aa, Artificial Sequence
  Synthetic peptide
  MISC_FEATURE: CDH3-29 VH CDR1
SYWMH

SEQ ID NO: 330 - protein, 17 aa, Artificial Sequence
  Synthetic peptide
  MISC_FEATURE: CDH3-29 VH CDR2
VIDTSDSYTIYNQKVKG

SEQ ID NO: 331 - protein, 8 aa, Artificial Sequence
  Synthetic peptide
  MISC_FEATURE: CDH3-29 VH CDR3
SGPGYFDV

SEQ ID NO: 332 - protein, 11 aa, Artificial Sequence
  Synthetic peptide
  MISC_FEATURE: CDH3-29 VL CDR1
RASGNIHNYLA

SEQ ID NO: 333 - protein, 7 aa, Artificial Sequence
  Synthetic peptide
  MISC_FEATURE: CDH3-29 VL CDR2
NAKTLAD

SEQ ID NO: 334 - protein, 9 aa, Artificial Sequence
  Synthetic peptide
  MISC_FEATURE: CDH3-29 VL CDR3
QHSWSTPYT

SEQ ID NO: 335 - protein, 117 aa, Artificial Sequence; identical to SEQ ID NO: 325
  Synthetic peptide
  MISC_FEATURE: CDH3-29 VH

SEQ ID NO: 336 - protein, 107 aa, Artificial Sequence
  Synthetic peptide
  MISC_FEATURE: CDH3-29 VL
DIQLTQSPSFLSASVGDRVTITCRASGNIHNYLAWYQQKPGKAPKLLIYNAKTLADGVPSRFSGSGSGTEFTLTISSLQPEDFATYYCQHSWSTPYTFGQGTKLEIK

SEQ ID NO: 337 - protein, 239 aa, Artificial Sequence
  Synthetic peptide
  MISC_FEATURE: CDH3-29 scFv
EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLTISSLQPEDFATYYCQHSWSTPYTFGQGTKLEIK

SEQ ID NO: 338 - protein, 494 aa, Artificial Sequence
  Synthetic peptide
  MISC_FEATURE: CDH3-29 bispecific molecule
EVQLLESGGGLVRPGGSLRLSCAASGYTFSSYWMHWVRQAPGKGLEWIGVIDTSDSYTIYNQKVKGRFTISRDNSKNTVYLQMNSLRAEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLTISSLQPEDFATYYCQHSWSTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 339 - protein, 5 aa, Artificial Sequence
  Synthetic peptide
  MISC_FEATURE: CDH3-30 VH CDR1
SYWMH

SEQ ID NO: 340 - protein, 17 aa, Artificial Sequence
  Synthetic peptide
  MISC_FEATURE: CDH3-30 VH CDR2
VIDTSDSYTIYNQKVKG

SEQ ID NO: 341 - protein, 8 aa, Artificial Sequence
  Synthetic peptide
  MISC_FEATURE: CDH3-30 VH CDR3
SGPGYFDV

SEQ ID NO: 342 - protein, 11 aa, Artificial Sequence
  Synthetic peptide
  MISC_FEATURE: CDH3-30 VL CDR1
RASENIYSYLA

SEQ ID NO: 343 - protein, 7 aa, Artificial Sequence
  Synthetic peptide
  MISC_FEATURE: CDH3-30 VL CDR2
NAKTLAE

SEQ ID NO: 344 - protein, 9 aa, Artificial Sequence
  Synthetic peptide
  MISC_FEATURE: CDH3-30 VL CDR3
QHHYGTPYT

SEQ ID NO: 345 - protein, 117 aa, Artificial Sequence
  Synthetic peptide
  MISC_FEATURE: CDH3-30 VH
EVQLLESGGGLVQPGGSLRLSCAASGYTFSSYWMHWVRQAPGKGLEWMGVIDTSDSYTIYNQKVKGRFTISRDNSKNTVYLQMNSLRAGDTAVYYCARSGPGYFDVWGQGTMVTVSS

SEQ ID NO: 346 - protein, 107 aa, Artificial Sequence
  Synthetic peptide
  MISC_FEATURE: CDH3-30 VL
DIQLTQSPSFLSASVGDRVTITCRASENIYSYLAWYQQKPGKAPKLLIYNAKTLAEGVPSRFSGSGSGTEFTLTISSLQPEDFGTYYCQHHYGTPYTFGQGTKLEIK

SEQ ID NO: 347 - protein, 239 aa, Artificial Sequence
  Synthetic peptide
  MISC_FEATURE: CDH3-30 scFv
EVQLLESGGGLVQPGGSLRLSCAASGYTFSSYWMHWVRQAPGKGLEWMGVIDTSDSYTIYNQKVKGRFTISRDNSKNTVYLQMNSLRAGDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFGTYYCQHHYGTPYTFGQGTKLEIK

SEQ ID NO: 348 - protein, 494 aa, Artificial Sequence
  Synthetic peptide
  MISC_FEATURE: CDH3-30 bispecific molecule
EVQLLESGGGLVQPGGSLRLSCAASGYTFSSYWMHWVRQAPGKGLEWMGVIDTSDSYTIYNQKVKGRFTISRDNSKNTVYLQMNSLRAGDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFGTYYCQHHYGTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 349 - protein, 5 aa, Artificial Sequence
  Synthetic peptide
  MISC_FEATURE: CDH3-31 VH CDR1
SYWMH

SEQ ID NO: 350 - protein, 17 aa, Artificial Sequence
  Synthetic peptide
  MISC_FEATURE: CDH3-31 VH CDR2
VIDTSDSYTIYNQKVKG

SEQ ID NO: 351 - protein, 8 aa, Artificial Sequence
  Synthetic peptide
  MISC_FEATURE: CDH3-31 VH CDR3
SGPGYFDV

SEQ ID NO: 352 - protein, 11 aa, Artificial Sequence
  Synthetic peptide
  MISC_FEATURE: CDH3-31 VL CDR1
RASENIYSYLA

SEQ ID NO: 353 - protein, 7 aa, Artificial Sequence
  Synthetic peptide
  MISC_FEATURE: CDH3-31 VL CDR2
NAKTLAE

SEQ ID NO: 354 - protein, 9 aa, Artificial Sequence
  Synthetic peptide
  MISC_FEATURE: CDH3-31 VL CDR3
QHHYGTPYT

SEQ ID NO: 355 - protein, 117 aa, Artificial Sequence
  Synthetic peptide
  MISC_FEATURE: CDH3-31 VH
EVQLLESGGGLVQPGGSLRLSCAASGYTFSSYWMHWVRQAPGKGLEWVGVIDTSDSYTIYNQKVKGRFTISRDTSKNTVYLQLNSLRAEDTAVYYCAKSGPGYFDVWGQGTMVTVSS

SEQ ID NO: 356 - protein, 107 aa, Artificial Sequence
  Synthetic peptide
  MISC_FEATURE: CDH3-31 VL
DIQLTQSPSFLSASVGDRVTITCRASENIYSYLAWYQQKPGKAPKLLIYNAKTLAEGVPSRFSGSGSGTEFTLTISSLQPEDFASYYCQHHYGTPYTFGQGTKLEIK

SEQ ID NO: 357 - protein, 239 aa, Artificial Sequence
  Synthetic peptide
  MISC_FEATURE: CDH3-31 scFv
EVQLLESGGGLVQPGGSLRLSCAASGYTFSSYWMHWVRQAPGKGLEWVGVIDTSDSYTIYNQKVKGRFTISRDTSKNTVYLQLNSLRAEDTAVYYCAKSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFASYYCQHHYGTPYTFGQGTKLEIK

SEQ ID NO: 358 - protein, 494 aa, Artificial Sequence
  Synthetic peptide
  MISC_FEATURE: CDH3-31 bispecific molecule
EVQLLESGGGLVQPGGSLRLSCAASGYTFSSYWMHWVRQAPGKGLEWVGVIDTSDSYTIYNQKVKGRFTISRDTSKNTVYLQLNSLRAEDTAVYYCAKSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFASYYCQHHYGTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 359 - protein, 5 aa, Artificial Sequence
  Synthetic peptide
  MISC_FEATURE: CDH3-32 VH CDR1
SYWMH

SEQ ID NO: 360 - protein, 17 aa, Artificial Sequence
  Synthetic peptide
  MISC_FEATURE: CDH3-32 VH CDR2
VIDTSDSYTIYNQKFKG

SEQ ID NO: 361 - protein, 8 aa, Artificial Sequence
  Synthetic peptide
  MISC_FEATURE: CDH3-32 VH CDR3
SGPGYFDV

SEQ ID NO: 362 - protein, 11 aa, Artificial Sequence
  Synthetic peptide
  MISC_FEATURE: CDH3-32 VL CDR1
RASENIYSYLA

SEQ ID NO: 363 - protein, 7 aa, Artificial Sequence
  Synthetic peptide
  MISC_FEATURE: CDH3-32 VH CDR2
NAKTLAE

SEQ ID NO: 364 - protein, 9 aa, Artificial Sequence
  Synthetic peptide
  MISC_FEATURE: CDH3-32 VL CDR3
QHHYGTPYT

SEQ ID NO: 365 - protein, 118 aa, Artificial Sequence
  Synthetic peptide
  MISC_FEATURE: CDH3-32 VH
EVQLVEQPGAELVRPGTSVKLSCKASGYTFTSYWMHWVKQRPGQGLEWIGVIDTSDSYTIYNQKFKGKATLTVDTSSSTAYMQLSSLTSEDSSVYFCARSGPGYFDVWGQGTTVTVSS

SEQ ID NO: 366 - protein, 107 aa, Artificial Sequence
  Synthetic peptide
  MISC_FEATURE: CDH3-32 VL
ELQMTQSPASLSASVGETVTITCRASENIYSYLAWYQQKQGKSPQLLVYNAKTLAEGVPSRFSGSGSGTQFSLKINSLQPEDFGSYYCQHHYGTPYTFGGGTKLEIK

SEQ ID NO: 367 - protein, 240 aa, Artificial Sequence
  Synthetic peptide
  MISC_FEATURE: CDH3-32 scFv
EVQLVEQPGAELVRPGTSVKLSCKASGYTFTSYWMHWVKQRPGQGLEWIGVIDTSDSYTIYNQKFKGKATLTVDTSSSTAYMQLSSLTSEDSSVYFCARSGPGYFDVWGQGTTVTVSSGGGGSGGGGSGGGGSELQMTQSPASLSASVGETVTITCRASENIYSYLAWYQQKQGKSPQLLVYNAKTLAEGVPSRFSGSGSGTQFSLKINSLQPEDFGSYYCQHHYGTPYTFGGGTKLEIK

SEQ ID NO: 368 - protein, 503 aa, Artificial Sequence
  Synthetic peptide
  MISC_FEATURE: CDH3-32 bispecific molecule
EVQLVEQPGAELVRPGTSVKLSCKASGYTFTSYWMHWVKQRPGQGLEWIGVIDTSDSYTIYNQKFKGKATLTVDTSSSTAYMQLSSLTSEDSSVYFCARSGPGYFDVWGQGTTVTVSSGGGGSGGGGSGGGGSELQMTQSPASLSASVGETVTITCRASENIYSYLAWYQQKQGKSPQLLVYNAKTLAEGVPSRFSGSGSGTQFSLKINSLQPEDFGSYYCQHHYGTPYTFGGGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 369 - protein, 5 aa, Artificial Sequence
  Synthetic peptide
  MISC_FEATURE: CDH3-33 VH CDR1
SYWMH

SEQ ID NO: 370 - protein, 17 aa, Artificial Sequence
  Synthetic peptide
  MISC_FEATURE: CDH3-33 VH CDR2
VIDTSDSYTIYNQKFKG

SEQ ID NO: 371 - protein, 8 aa, Artificial Sequence
  Synthetic peptide
  MISC_FEATURE: CDH3-33 VH CDR3
SGPGYFDV

SEQ ID NO: 372 - protein, 11 aa, Artificial Sequence
  Synthetic peptide
  MISC_FEATURE: CDH3-33 VL CDR1
RASGNIHNYLA

SEQ ID NO: 373 - protein, 7 aa, Artificial Sequence
  Synthetic peptide
  MISC_FEATURE: CDH3-33 VL CDR2
NAKTLAD

SEQ ID NO: 374 - protein, 9 aa, Artificial Sequence
  Synthetic peptide
  MISC_FEATURE: CDH3-33 VL CDR3
QHFWSTPYT

SEQ ID NO: 375 - protein, 118 aa, Artificial Sequence
  Synthetic peptide
  MISC_FEATURE: CDH3-33 VH
EVQLVEQPGAELVRPGTSVKLSCKASGYTFTSYWMHWVKQRPGQGLEWIGVIDTSDSYTIYNQKFKGKATLTVDTSSSTAYMQLSSLTSGDSSVYFCARSGPGYFDVWGQGTTVTVSS

SEQ ID NO: 376 - protein, 107 aa, Artificial Sequence
  Synthetic peptide
  MISC_FEATURE: CDH3-33 VL
ELVMTQSPASLSASVGETVTITCRASGNIHNYLAWYQQKQGKSPQLLVYNAKTLADGVPSRFSGSGSGTQYSLKINSLQPEDFGTYYCQHFWSTPYTFGGGTKLEIK

SEQ ID NO: 377 - protein, 240 aa, Artificial Sequence
  Synthetic peptide
  MISC_FEATURE: CDH3-33 scFv
EVQLVEQPGAELVRPGTSVKLSCKASGYTFTSYWMHWVKQRPGQGLEWIGVIDTSDSYTIYNQKFKGKATLTVDTSSSTAYMQLSSLTSGDSSVYFCARSGPGYFDVWGQGTTVTVSSGGGGSGGGGSGGGGSELVMTQSPASLSASVGETVTITCRASGNIHNYLAWYQQKQGKSPQLLVYNAKTLADGVPSRFSGSGSGTQYSLKINSLQPEDFGTYYCQHFWSTPYTFGGGTKLEIK

SEQ ID NO: 378 - protein, 503 aa, Artificial Sequence
  Synthetic peptide
  MISC_FEATURE: CDH3-33 bispecific molecule
EVQLVEQPGAELVRPGTSVKLSCKASGYTFTSYWMHWVKQRPGQGLEWIGVIDTSDSYTIYNQKFKGKATLTVDTSSSTAYMQLSSLTSGDSSVYFCARSGPGYFDVWGQGTTVTVSSGGGGSGGGGSGGGGSELVMTQSPASLSASVGETVTITCRASGNIHNYLAWYQQKQGKSPQLLVYNAKTLADGVPSRFSGSGSGTQYSLKINSLQPEDFGTYYCQHFWSTPYTFGGGTKLEIKRTSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 379 - protein, 1097 aa, Artificial Sequence
  Synthetic peptide
  MISC_FEATURE: CDH3-13 xI2C -HALB
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 380 - protein, 1097 aa, Artificial Sequence
  Synthetic peptide
  MISC_FEATURE: CDH3-13 xI2C -HALB-variant-1
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 381 - protein, 549 aa, Artificial Sequence
  Synthetic peptide
  MISC_FEATURE: CDH3-13 xI2C -LY-FcB-CH
QRFVTGHFGGLYPANGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGP

SEQ ID NO: 382 - protein, 549 aa, Artificial Sequence
  Synthetic peptide
  MISC_FEATURE: CDH3-13 xI2C -LH-FcB-CH
QRFVTGHFGGLHPANGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGP

SEQ ID NO: 383 - protein, 549 aa, Artificial Sequence
  Synthetic peptide
  MISC_FEATURE: CDH3-13 xI2C -LH-FcB-LH
QRFVTGHFGGLHPANGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGP

SEQ ID NO: 384 - protein, 549 aa, Artificial Sequence
  Synthetic peptide
  MISC_FEATURE: CDH3-13 xI2C -LY-FcB-LH
QRFVTGHFGGLYPANGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGP

SEQ ID NO: 385 - protein, 549 aa, Artificial Sequence
  Synthetic peptide
  MISC_FEATURE: CDH3-13 xI2C -CH-FcB-LH
QRFCTGHFGGLHPCNGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGP

SEQ ID NO: 386 - protein, 549 aa, Artificial Sequence
  Synthetic peptide
  MISC_FEATURE: CDH3-13 xI2C -CH-FcB-LY
QRFCTGHFGGLHPCNGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGP

SEQ ID NO: 387 - protein, 532 aa, Artificial Sequence
  Synthetic peptide
  MISC_FEATURE: CDH3-13 xI2C -156
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGP

SEQ ID NO: 388 - protein, 574 aa, Artificial Sequence
  Synthetic peptide
  MISC_FEATURE: CDH3-13 xI2C -LY-FcB-CH-156
QRFVTGHFGGLYPANGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGP

SEQ ID NO: 389 - protein, 574 aa, Artificial Sequence
  Synthetic peptide
  MISC_FEATURE: CDH3-13 xI2C -CH-FcB-LY-156
QRFCTGHFGGLHPCNGGGGGSEVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGP

SEQ ID NO: 390 - protein, 37 aa, Artificial Sequence
  Synthetic peptide
  MISC_FEATURE: Human epitope cluster D3C
HTLYVEVTNEAPFVLKLPTSTATIVVHVEDVNEAPVF

SEQ ID NO: 391 - protein, 37 aa, Artificial Sequence; identical to SEQ ID NO: 390
  Synthetic peptide
  MISC_FEATURE: Macaque epitope cluster D3C

SEQ ID NO: 392 - protein, 4 aa, Artificial Sequence
  Synthetic peptide
  MISC_FEATURE: linker 1
GGGG

SEQ ID NO: 393 - protein, 5 aa, Artificial Sequence
  Synthetic peptide
  MISC_FEATURE: linker 2
GGGGS

SEQ ID NO: 394 - protein, 5 aa, Artificial Sequence
  Synthetic peptide
  MISC_FEATURE: linker 3
GGGGQ

SEQ ID NO: 395 - protein, 6 aa, Artificial Sequence
  Synthetic peptide
  MISC_FEATURE: linker 4
SGGGGS

SEQ ID NO: 396 - protein, 6 aa, Artificial Sequence
  Synthetic peptide
  MISC_FEATURE: linker 5
PGGGGS

SEQ ID NO: 397 - protein, 6 aa, Artificial Sequence
  Synthetic peptide
  MISC_FEATURE: linker 6
PGGDGS

SEQ ID NO: 398 - protein, 9 aa, Artificial Sequence
  Synthetic peptide
  MISC_FEATURE: linker 7
GGGGSGGGS

SEQ ID NO: 399 - protein, 10 aa, Artificial Sequence
  Synthetic peptide
  MISC_FEATURE: linker 8
GGGGSGGGGS

SEQ ID NO: 400 - protein, 15 aa, Artificial Sequence
  Synthetic peptide
  MISC_FEATURE: linker 9
GGGGSGGGGSGGGGS

SEQ ID NO: 401 - protein, 20 aa, Artificial Sequence
  Synthetic peptide
  MISC_FEATURE: linker 10
GGGGSGGGGSGGGGSGGGGS

SEQ ID NO: 402 - protein, 25 aa, Artificial Sequence
  Synthetic peptide
  MISC_FEATURE: linker 11
GGGGSGGGGSGGGGSGGGGSGGGGS

SEQ ID NO: 403 - protein, 30 aa, Artificial Sequence
  Synthetic peptide
  MISC_FEATURE: linker 12
GGGGSGGGGSGGGGSGGGGSGGGGSGGGGS

SEQ ID NO: 404 - protein, 35 aa, Artificial Sequence
  Synthetic peptide
  MISC_FEATURE: linker 13
GGGGSGGGGSGGGGSGGGGSGGGGSGGGGSGGGGS

SEQ ID NO: 405 - protein, 40 aa, Artificial Sequence
  Synthetic peptide
  MISC_FEATURE: linker 14
GGGGSGGGGSGGGGSGGGGSGGGGSGGGGSGGGGSGGGGS

SEQ ID NO: 406 - protein, 227 aa, Artificial Sequence
  Synthetic peptide
  MISC_FEATURE: Fc monomer-1+c/-g
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 407 - protein, 225 aa, Artificial Sequence
  Synthetic peptide
  MISC_FEATURE: Fc monomer-2 +c/-g/delGK
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 408 - protein, 227 aa, Artificial Sequence
  Synthetic peptide
  MISC_FEATURE: Fc monomer-3 -c/+g
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 409 - protein, 225 aa, Artificial Sequence
  Synthetic peptide
  MISC_FEATURE: Fc monomer-4 -c/+g/ delGK
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 410 - protein, 227 aa, Artificial Sequence
  Synthetic peptide
  MISC_FEATURE: Fc monomer-5 -c/-g
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - protein, 225 aa, Artificial Sequence
  Synthetic peptide
  MISC_FEATURE: Fc monomer-6-c/-g/ delGK
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 412 - protein, 227 aa, Artificial Sequence
  Synthetic peptide
  MISC_FEATURE: Fc monomer-7 +c/+g
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 225 aa, Artificial Sequence
  Synthetic peptide
  MISC_FEATURE: Fc monomer-8 +c/+g/ delGK
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 414 - protein, 484 aa, Artificial Sequence
  Synthetic peptide
  MISC_FEATURE: scFc-1
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 480 aa, Artificial Sequence
  Synthetic peptide
  MISC_FEATURE: scFc-2
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 416 - protein, 484 aa, Artificial Sequence
  Synthetic peptide
  MISC_FEATURE: scFc-3
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 480 aa, Artificial Sequence
  Synthetic peptide
  MISC_FEATURE: scFc-4
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 418 - protein, 484 aa, Artificial Sequence
  Synthetic peptide
  MISC_FEATURE: scFc-5
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 480 aa, Artificial Sequence
  Synthetic peptide
  MISC_FEATURE: scFc-6
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 420 - protein, 484 aa, Artificial Sequence
  Synthetic peptide
  MISC_FEATURE: scFc-7
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 480 aa, Artificial Sequence
  Synthetic peptide
  MISC_FEATURE: scFc-8
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 422 - protein, 994 aa, Artificial Sequence
  Synthetic peptide
  MISC_FEATURE: CDH3-11 xI2C -scFc
EVQLLESGGGLVQPGGSLRLSCAVSGFTLSSYPINWVRQAPGKGLEWVSVIWTGGGTNYASSVKGRFTISRDNSKNTLYLQMNSLRAEDTAVYYCAKSRGVYDFDGRGAMDYWGQGTLVTVSSGGGGSGGGGSGGGGSDIVMTQSPDSLAVSVGERVTINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 423 - protein, 994 aa, Artificial Sequence
  Synthetic peptide
  MISC_FEATURE: CDH3-12 xF12q -scFc
QVQLQESGPGLVKPSETLSLTCTVSGVSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPASLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 424 - protein, 994 aa, Artificial Sequence
  Synthetic peptide
  MISC_FEATURE: CDH3-12 xI2C -scFc
QVQLQESGPGLVKPSETLSLTCTVSGVSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPASLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - protein, 994 aa, Artificial Sequence
  Synthetic peptide
  MISC_FEATURE: CDH3-13 xI2C -scFc
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 994 aa, Artificial Sequence
  Synthetic peptide
  MISC_FEATURE: CDH3-14 xF12q -scFc
QVQLQESGPGLVKPSETLSLTCTVSGGSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 427 - protein, 994 aa, Artificial Sequence
  Synthetic peptide
  MISC_FEATURE: CDH3-14 xI2C -scFc
QVQLQESGPGLVKPSETLSLTCTVSGGSITSYPINWIRQPPGKGLEWIGVIWTGGGTNYNPSLKSRVTISVDTSKNQFSLKLSSVTAADTAVYYCARSRGVYDFDGRGAMDYWGQGTLVTVSSGGGGSGGGGSGGGGSDIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 428 - protein, 982 aa, Artificial Sequence
  Synthetic peptide
  MISC_FEATURE: CDH3-24 xF12q -scFc
QVQLVQSGAEVKKPGASVKVSCKASGYTFTSYWMHWVRQAPGQGLEWMGVIDTSDSYTIYNQKFQGRVTMTRDTSTSTAYMELSSLRSEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLKISSLQPEDFATYYCQHFWSTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 982 aa, Artificial Sequence
  Synthetic peptide
  MISC_FEATURE: CDH3-24 xI2C -scFc
QVQLVQSGAEVKKPGASVKVSCKASGYTFTSYWMHWVRQAPGQGLEWMGVIDTSDSYTIYNQKFQGRVTMTRDTSTSTAYMELSSLRSEDTAVYYCARSGPGYFDVWGQGTMVTVSSGGGGSGGGGSGGGGSDIQLTQSPSFLSASVGDRVTITCRASGNIHNYLAWYQQKPGKAPKLLIYNAKTLADGVPSRFSGSGSGTEFTLKISSLQPEDFATYYCQHFWSTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 430 - protein, 982 aa, Artificial Sequence
  Synthetic peptide
  MISC_FEATURE: CDH3-25 xF12q -scFc
QVQLVQSGAEVKKPGASVKVSCKASGYTFTSYWMHWVRQAPGQGLEWMGVIDTSDSYTIYNQKFKGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 982 aa, Artificial Sequence
  Synthetic peptide
  MISC_FEATURE: CDH3-25 xI2C -scFc
QVQLVQSGAEVKKPGASVKVSCKASGYTFTSYWMHWVRQAPGQGLEWMGVIDTSDSYTIYNQKFKGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - protein, 982 aa, Artificial Sequence
  Synthetic peptide
  MISC_FEATURE: CDH3-26 xF12q -scFc
QVQLVQSGAEVKKPGASVKVSCKASGYTFTSYWMHWVRQAPGQGLEWMGVIDTSDSYTIYNQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLVYNAKTLAEGVPSRFSGSGSGTEFTLTISSLQPEDFATYYCQHHYGTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 433 - protein, 982 aa, Artificial Sequence
  Synthetic peptide
  MISC_FEATURE: CDH3-26 xI2C -scFc
QVQLVQSGAEVKKPGASVKVSCKASGYTFTSYWMHWVRQAPGQGLEWMGVIDTSDSYTIYNQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLVYNAKTLAEGVPSRFSGSGSGTEFTLTISSLQPEDFATYYCQHHYGTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 434 - protein, 982 aa, Artificial Sequence
  Synthetic peptide
  MISC_FEATURE: CDH3-27 xF12q -scFc
QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 982 aa, Artificial Sequence
  Synthetic peptide
  MISC_FEATURE: CDH3-27 xI2C -scFc
QVQLVQSGAEVKKPGASVKVSCKASGYTFTSYWMHWVRQAPGQGLEWMGVIDTSDSYTIYAQKFQGRVTMTRDTSTSTVYMELSSLRSEDTAVYYCARSGPGYFDVWGQGTMVTVSSGGGGSGGGGSGGGGSDIQLTQSPSFLSASVGDRVTITCRASENIYSYLAWYQQKPGKAPKLLIYNAKTLAEGVPSRFSGSGSGTEFTLTISSLQPEDFATYYCQHHYGTPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 436 - protein, 6 aa, Artificial Sequence
  Synthetic peptide
  MISC_FEATURE: Hexa-his
HHHHHH

SEQ ID NO: 437 - protein, 16 aa, Artificial Sequence
  Synthetic peptide
  MISC_FEATURE: P156
RDWDFDVFGGGTPVGG

SEQ ID NO: 438 - protein, 16 aa, Artificial Sequence
  Synthetic peptide
  MISC_FEATURE: linear FcRn BP
  misc_feature (12)..(12): Xaa can be any naturally occurring amino acid
QRFVTGHFGGLXPANG

SEQ ID NO: 439 - protein, 16 aa, Artificial Sequence
  Synthetic peptide
  MISC_FEATURE: linear FcRn BP-Y
QRFVTGHFGGLYPANG

SEQ ID NO: 440 - protein, 16 aa, Artificial Sequence
  Synthetic peptide
  MISC_FEATURE: linear FcRn BP-H
QRFVTGHFGGLHPANG

SEQ ID NO: 441 - protein, 9 aa, Artificial Sequence
  Synthetic peptide
  MISC_FEATURE: core FcRn BP-H
TGHFGGLHP

SEQ ID NO: 442 - protein, 16 aa, Artificial Sequence
  Synthetic peptide
  MISC_FEATURE: cyclic FcRn BP-H
QRFCTGHFGGLHPCNG

SEQ ID NO: 443 - protein, 585 aa, Artificial Sequence [sequence omitted]

SEQ ID NO: 444 - protein, 585 aa, Artificial Sequence
  Synthetic peptide
  MISC_FEATURE: HALB variant 1
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 445 - protein, 14 aa, Artificial Sequence
  Synthetic peptide
  MISC_FEATURE: CDR-L1 of F6A
GSSTGAVTSGYYPN

SEQ ID NO: 446 - protein, 7 aa, Artificial Sequence
  Synthetic peptide
  MISC_FEATURE: CDR-L2 of F6A
GTKFLAP

SEQ ID NO: 447 - protein, 9 aa, Artificial Sequence
  Synthetic peptide
  MISC_FEATURE: CDR-L3 of F6A
ALWYSNRWV

SEQ ID NO: 448 - protein, 5 aa, Artificial Sequence
  Synthetic peptide
  MISC_FEATURE: CDR-H1 of F6A
IYAMN

SEQ ID NO: 449 - protein, 19 aa, Artificial Sequence
  Synthetic peptide
  MISC_FEATURE: CDR-H2 of F6A
RIRSKYNNYATYYADSVKS

SEQ ID NO: 450 - protein, 14 aa, Artificial Sequence
  Synthetic peptide
  MISC_FEATURE: CDR-H3 of F6A
HGNFGNSYVSFFAY

SEQ ID NO: 451 - protein, 125 aa, Artificial Sequence
  Synthetic peptide
  MISC_FEATURE: VH of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 452 - protein, 109 aa, Artificial Sequence
  Synthetic peptide
  MISC_FEATURE: VL of F6A
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 453 - protein, 249 aa, Artificial Sequence
  Synthetic peptide
  MISC_FEATURE: VH-VL of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 454 - protein, 14 aa, Artificial Sequence
  Synthetic peptide
  MISC_FEATURE: CDR-L1 of H2C
GSSTGAVTSGYYPN

SEQ ID NO: 455 - protein, 7 aa, Artificial Sequence
  Synthetic peptide
  MISC_FEATURE: CDR-L2 of H2C
GTKFLAP

SEQ ID NO: 456 - protein, 9 aa, Artificial Sequence
  Synthetic peptide
  MISC_FEATURE: CDR-L3 of H2C
ALWYSNRWV

SEQ ID NO: 457 - protein, 5 aa, Artificial Sequence
  Synthetic peptide
  MISC_FEATURE: CDR-H1 of H2C
KYAMN

SEQ ID NO: 458 - protein, 19 aa, Artificial Sequence
  Synthetic peptide
  MISC_FEATURE: CDR-H2 of H2C
RIRSKYNNYATYYADSVKD

SEQ ID NO: 459 - protein, 14 aa, Artificial Sequence
  Synthetic peptide
  MISC_FEATURE: CDR-H3 of H2C
HGNFGNSYISYWAY

SEQ ID NO: 460 - protein, 125 aa, Artificial Sequence
  Synthetic peptide
  MISC_FEATURE: VH of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 461 - protein, 109 aa, Artificial Sequence; identical to SEQ ID NO: 452
  Synthetic peptide
  MISC_FEATURE: VL of H2C

SEQ ID NO: 462 - protein, 249 aa, Artificial Sequence
  Synthetic peptide
  MISC_FEATURE: VH-VL of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 463 - protein, 14 aa, Artificial Sequence
  Synthetic peptide
  MISC_FEATURE: CDR-L1 of H1E
GSSTGAVTSGYYPN

SEQ ID NO: 464 - protein, 7 aa, Artificial Sequence
  Synthetic peptide
  MISC_FEATURE: CDR-L2 of H1E
GTKFLAP

SEQ ID NO: 465 - protein, 9 aa, Artificial Sequence
  Synthetic peptide
  MISC_FEATURE: CDR-L3 of H1E
ALWYSNRWV

SEQ ID NO: 466 - protein, 5 aa, Artificial Sequence
  Synthetic peptide
  MISC_FEATURE: CDR-H1 of H1E
SYAMN

SEQ ID NO: 467 - protein, 19 aa, Artificial Sequence
  Synthetic peptide
  MISC_FEATURE: CDR-H2 of H1E
RIRSKYNNYATYYADSVKG

SEQ ID NO: 468 - protein, 14 aa, Artificial Sequence
  Synthetic peptide
  MISC_FEATURE: CDR-H3 of H1E
HGNFGNSYLSFWAY

SEQ ID NO: 469 - protein, 125 aa, Artificial Sequence
  Synthetic peptide
  MISC_FEATURE: VH of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 470 - protein, 109 aa, Artificial Sequence; identical to SEQ ID NO: 452
  Synthetic peptide
  MISC_FEATURE: VL of H1E

SEQ ID NO: 471 - protein, 249 aa, Artificial Sequence
  Synthetic peptide
  MISC_FEATURE: VH-VL of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 472 - protein, 14 aa, Artificial Sequence
  Synthetic peptide
  MISC_FEATURE: CDR-L1 of G4H
GSSTGAVTSGYYPN

SEQ ID NO: 473 - protein, 7 aa, Artificial Sequence
  Synthetic peptide
  MISC_FEATURE: CDR-L2 of G4H
GTKFLAP

SEQ ID NO: 474 - protein, 9 aa, Artificial Sequence
  Synthetic peptide
  MISC_FEATURE: CDR-L3 of G4H
ALWYSNRWV

SEQ ID NO: 475 - protein, 5 aa, Artificial Sequence
  Synthetic peptide
  MISC_FEATURE: CDR-H1 of G4H
RYAMN

SEQ ID NO: 476 - protein, 19 aa, Artificial Sequence
  Synthetic peptide
  MISC_FEATURE: CDR-H2 of G4H
RIRSKYNNYATYYADSVKG

SEQ ID NO: 477 - protein, 14 aa, Artificial Sequence
  Synthetic peptide
  MISC_FEATURE: CDR-H3 of G4H
HGNFGNSYLSYFAY

SEQ ID NO: 478 - protein, 125 aa, Artificial Sequence
  Synthetic peptide
  MISC_FEATURE: VH of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 479 - protein, 109 aa, Artificial Sequence; identical to SEQ ID NO: 452
  Synthetic peptide
  MISC_FEATURE: VL of G4H

SEQ ID NO: 480 - protein, 249 aa, Artificial Sequence
  Synthetic peptide
  MISC_FEATURE: VH-VL of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 481 - protein, 14 aa, Artificial Sequence
  Synthetic peptide
  MISC_FEATURE: CDR-L1 of A2J
RSSTGAVTSGYYPN

SEQ ID NO: 482 - protein, 7 aa, Artificial Sequence
  Synthetic peptide
  MISC_FEATURE: CDR-L2 of A2J
ATDMRPS

SEQ ID NO: 483 - protein, 9 aa, Artificial Sequence
  Synthetic peptide
  MISC_FEATURE: CDR-L3 of A2J
ALWYSNRWV

SEQ ID NO: 484 - protein, 5 aa, Artificial Sequence
  Synthetic peptide
  MISC_FEATURE: CDR-H1 of A2J
VYAMN

SEQ ID NO: 485 - protein, 19 aa, Artificial Sequence
  Synthetic peptide
  MISC_FEATURE: CDR-H2 of A2J
RIRSKYNNYATYYADSVKK

SEQ ID NO: 486 - protein, 14 aa, Artificial Sequence
  Synthetic peptide
  MISC_FEATURE: CDR-H3 of A2J
HGNFGNSYLSWWAY

SEQ ID NO: 487 - protein, 125 aa, Artificial Sequence
  Synthetic peptide
  MISC_FEATURE: VH of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 488 - protein, 109 aa, Artificial Sequence
  Synthetic peptide
  MISC_FEATURE: VL of A2J
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 489 - protein, 249 aa, Artificial Sequence
  Synthetic peptide
  MISC_FEATURE: VH-VL of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 490 - protein, 14 aa, Artificial Sequence
  Synthetic peptide
  MISC_FEATURE: CDR-L1 of E1L
GSSTGAVTSGYYPN

SEQ ID NO: 491 - protein, 7 aa, Artificial Sequence
  Synthetic peptide
  MISC_FEATURE: CDR-L2 of E1L
GTKFLAP

SEQ ID NO: 492 - protein, 9 aa, Artificial Sequence
  Synthetic peptide
  MISC_FEATURE: CDR-L3 of E1L
ALWYSNRWV

SEQ ID NO: 493 - protein, 5 aa, Artificial Sequence
  Synthetic peptide
  MISC_FEATURE: CDR-H1 of E1L
KYAMN

SEQ ID NO: 494 - protein, 19 aa, Artificial Sequence
  Synthetic peptide
  MISC_FEATURE: CDR-H2 of E1L
RIRSKYNNYATYYADSVKS

SEQ ID NO: 495 - protein, 14 aa, Artificial Sequence
  Synthetic peptide
  MISC_FEATURE: CDR-H3 of E1L
HGNFGNSYTSYYAY

SEQ ID NO: 496 - protein, 125 aa, Artificial Sequence
  Synthetic peptide
  MISC_FEATURE: VH of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 497 - protein, 109 aa, Artificial Sequence; identical to SEQ ID NO: 452
  Synthetic peptide
  MISC_FEATURE: VL of E1L

SEQ ID NO: 498 - protein, 249 aa, Artificial Sequence
  Synthetic peptide
  MISC_FEATURE: VH-VL of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 499 - protein, 14 aa, Artificial Sequence
  Synthetic peptide
  MISC_FEATURE: CDR-L1 of E2M
RSSTGAVTSGYYPN

SEQ ID NO: 500 - protein, 7 aa, Artificial Sequence
  Synthetic peptide
  MISC_FEATURE: CDR-L2 of E2M
ATDMRPS

SEQ ID NO: 501 - protein, 9 aa, Artificial Sequence
  Synthetic peptide
  MISC_FEATURE: CDR-L3 of E2M
ALWYSNRWV

SEQ ID NO: 502 - protein, 5 aa, Artificial Sequence
  Synthetic peptide
  MISC_FEATURE: CDR-H1 of E2M
GYAMN

SEQ ID NO: 503 - protein, 19 aa, Artificial Sequence
  Synthetic peptide
  MISC_FEATURE: CDR-H2 of E2M
RIRSKYNNYATYYADSVKE

SEQ ID NO: 504 - protein, 14 aa, Artificial Sequence
  Synthetic peptide
  MISC_FEATURE: CDR-H3 of E2M
HRNFGNSYLSWFAY

SEQ ID NO: 505 - protein, 125 aa, Artificial Sequence
  Synthetic peptide
  MISC_FEATURE: VH of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 506 - protein, 109 aa, Artificial Sequence; identical to SEQ ID NO: 488
  Synthetic peptide
  MISC_FEATURE: VL of E2M

SEQ ID NO: 507 - protein, 249 aa, Artificial Sequence
  Synthetic peptide
  MISC_FEATURE: VH-VL of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 508 - protein, 14 aa, Artificial Sequence
  Synthetic peptide
  MISC_FEATURE: CDR-L1 of F7O
GSSTGAVTSGYYPN

SEQ ID NO: 509 - protein, 7 aa, Artificial Sequence
  Synthetic peptide
  MISC_FEATURE: CDR-L2 of F7O
GTKFLAP

SEQ ID NO: 510 - protein, 9 aa, Artificial Sequence
  Synthetic peptide
  MISC_FEATURE: CDR-L3 of F7O
ALWYSNRWV

SEQ ID NO: 511 - protein, 5 aa, Artificial Sequence
  Synthetic peptide
  MISC_FEATURE: CDR-H1 of F7O
VYAMN

SEQ ID NO: 512 - protein, 19 aa, Artificial Sequence
  Synthetic peptide
  MISC_FEATURE: CDR-H2 of F7O
RIRSKYNNYATYYADSVKK

SEQ ID NO: 513 - protein, 14 aa, Artificial Sequence
  Synthetic peptide
  MISC_FEATURE: CDR-H3 of F7O
HGNFGNSYISWWAY

SEQ ID NO: 514 - protein, 125 aa, Artificial Sequence
  Synthetic peptide
  MISC_FEATURE: VH of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 515 - protein, 109 aa, Artificial Sequence; identical to SEQ ID NO: 452
  Synthetic peptide
  MISC_FEATURE: VL of F7O

SEQ ID NO: 516 - protein, 249 aa, Artificial Sequence
  Synthetic peptide
  MISC_FEATURE: VH-VL of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 517 - protein, 14 aa, Artificial Sequence
  Synthetic peptide
  MISC_FEATURE: CDR-L1 of F12Q
GSSTGAVTSGNYPN

SEQ ID NO: 518 - protein, 7 aa, Artificial Sequence
  Synthetic peptide
  MISC_FEATURE: CDR-L2 of F12Q
GTKFLAP

SEQ ID NO: 519 - protein, 9 aa, Artificial Sequence
  Synthetic peptide
  MISC_FEATURE: CDR-L3 of F12Q
VLWYSNRWV

SEQ ID NO: 520 - protein, 5 aa, Artificial Sequence
  Synthetic peptide
  MISC_FEATURE: CDR-H1 of F12Q
SYAMN

SEQ ID NO: 521 - protein, 19 aa, Artificial Sequence
  Synthetic peptide
  MISC_FEATURE: CDR-H2 of F12Q
RIRSKYNNYATYYADSVKG

SEQ ID NO: 522 - protein, 14 aa, Artificial Sequence
  Synthetic peptide
  MISC_FEATURE: CDR-H3 of F12Q
HGNFGNSYVSWWAY

SEQ ID NO: 523 - protein, 125 aa, Artificial Sequence
  Synthetic peptide
  MISC_FEATURE: VH of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 524 - protein, 109 aa, Artificial Sequence
  Synthetic peptide
  MISC_FEATURE: VL of F12Q
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 525 - protein, 249 aa, Artificial Sequence
  Synthetic peptide
  MISC_FEATURE: VH-VL of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 526 - protein, 14 aa, Artificial Sequence
  Synthetic peptide
  MISC_FEATURE: CDR-L1 of I2C
GSSTGAVTSGNYPN

SEQ ID NO: 527 - protein, 7 aa, Artificial Sequence
  Synthetic peptide
  MISC_FEATURE: CDR-L2 of I2C
GTKFLAP

SEQ ID NO: 528 - protein, 9 aa, Artificial Sequence
  Synthetic peptide
  MISC_FEATURE: CDR-L3 of I2C
VLWYSNRWV

SEQ ID NO: 529 - protein, 5 aa, Artificial Sequence
  Synthetic peptide
  MISC_FEATURE: CDR-H1 of I2C
KYAMN

SEQ ID NO: 530 - protein, 19 aa, Artificial Sequence
  Synthetic peptide
  MISC_FEATURE: CDR-H2 of I2C
RIRSKYNNYATYYADSVKD

SEQ ID NO: 531 - protein, 14 aa, Artificial Sequence
  Synthetic peptide
  MISC_FEATURE: CDR-H3 of I2C
HGNFGNSYISYWAY

SEQ ID NO: 532 - protein, 125 aa, Artificial Sequence; identical to SEQ ID NO: 460
  Synthetic peptide
  MISC_FEATURE: VH of I2C

SEQ ID NO: 533 - protein, 109 aa, Artificial Sequence; identical to SEQ ID NO: 524
  Synthetic peptide
  MISC_FEATURE: VL of I2C

SEQ ID NO: 534 - protein, 249 aa, Artificial Sequence
  Synthetic peptide
  MISC_FEATURE: VH-VL of I2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 535 - protein, 125 aa, Artificial Sequence
  Synthetic peptide
  MISC_FEATURE: VH of F12q
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 536 - protein, 109 aa, Artificial Sequence; identical to SEQ ID NO: 524
  Synthetic peptide
  MISC_FEATURE: VL of F12q

SEQ ID NO: 537 - protein, 249 aa, Artificial Sequence
  Synthetic peptide
  MISC_FEATURE: VH-VL of F12q
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 538 - DNA, 19 bp, Artificial Sequence
  Synthetic oligonucleotide
  misc_feature: hu CDH3 sequence specific oligonucleotide
ggcccgccgtcgcggcagc

SEQ ID NO: 539 - DNA, 22 bp, Artificial Sequence
  Synthetic oligonucleotide
  misc_feature: hu CDH3 sequence specific oligonucleotide
ctccttctccaggtttgctggc

SEQ ID NO: 540 - DNA, 22 bp, Artificial Sequence
  Synthetic oligonucleotide
  misc_feature: hu CDH3 sequence specific oligonucleotide
aactgagaccccttggagatgc

SEQ ID NO: 541 - DNA, 20 bp, Artificial Sequence
  Synthetic oligonucleotide
  misc_feature: hu CDH3 sequence specific oligonucleotide
tagtcgtcctccccgccacc

SEQ ID NO: 542 - DNA, 21 bp, Artificial Sequence
  Synthetic oligonucleotide
  misc_feature: hu CDH3 sequence specific oligonucleotide
ggagggtgggacaaacacagg

SEQ ID NO: 543 - DNA, 22 bp, Artificial Sequence
  Synthetic oligonucleotide
  misc_feature: hu CDH3 sequence specific oligonucleotide
acgttgaagtgaccaacgaggc

The invention claimed is:

1. A bispecific single chain antibody construct comprising a first human binding domain which binds to an epitope cluster of human CDH3 and macaque CDH3 on the surface of a target cell; and
a second binding domain which binds to human CD3 on the surface of a T cell,
wherein the epitope cluster of human CDH3 is comprised within amino acid positions 291-363 (SEQ ID NO: 36) of human CDH3, and
wherein the first binding domain comprises a VH region and a VL region selected from the group consisting of:
   a) a VH region comprising a CDR-H1 as depicted in SEQ ID NO: 169, a CDR-H2 as depicted in SEQ ID NO: 170, and a CDR-H3 as depicted in SEQ ID NO: 171, and a VL region comprising a CDR-L1 as depicted in SEQ ID NO: 172, a CDR-L2 as depicted in SEQ ID NO: 173, and a CDR-L3 as depicted in SEQ ID NO: 174;
   b) a VH region comprising a CDR-H1 as depicted in SEQ ID NO: 279, a CDR-H2 as depicted in SEQ ID NO: 280, and a CDR-H3 as depicted in SEQ ID NO: 281, and a VL region comprising a CDR-L1 as depicted in SEQ ID NO: 282, a CDR-L2 as depicted in SEQ ID NO: 283, and a CDR-L3 as depicted in SEQ ID NO: 284;
   c) a VH region comprising a CDR-H1 as depicted in SEQ ID NO: 289, a CDR-H2 as depicted in SEQ ID NO: 290, and a CDR-H3 as depicted in SEQ ID NO: 291, and a VL region comprising a CDR-L1 as depicted in SEQ ID NO: 292, a CDR-L2 as depicted in SEQ ID NO: 293, and a CDR-L3 as depicted in SEQ ID NO: 294;
   d) a VH region comprising a CDR-H1 as depicted in SEQ ID NO: 299, a CDR-H2 as depicted in SEQ ID NO: 300, and a CDR-H3 as depicted in SEQ ID NO: 301, and a VL region comprising a CDR-L1 as depicted in SEQ ID NO: 302, a CDR-L2 as depicted in SEQ ID NO: 303, and a CDR-L3 as depicted in SEQ ID NO: 304;
   e) a VH region comprising a CDR-H1 as depicted in SEQ ID NO: 309, a CDR-H2 as depicted in SEQ ID NO: 310, and a CDR-H3 as depicted in SEQ ID NO: 311, and a VL region comprising a CDR-L1 as depicted in SEQ ID NO: 312, a CDR-L2 as depicted in SEQ ID NO: 313, and a CDR-L3 as depicted in SEQ ID NO: 314.

2. The antibody construct according to claim 1, wherein the first binding domain binds to an epitope which is comprised within amino acid positions 291-327 (SEQ ID NO: 34) of human CDH3.

3. The antibody construct according to claim 1, wherein the first binding domain binds to an epitope which is comprised within amino acid positions 328-363 (SEQ ID NO: 35) of human CDH3.

4. The antibody construct according to claim 3, wherein the first binding domain also binds to an epitope which is comprised within amino acid positions 404-440 (SEQ ID NO: 390) of human CDH3.

5. The antibody construct according to claim 1, wherein the macaque CDH3 is *Macaca fascicularis* CDH3.

6. The antibody construct according to claim 1, wherein the first binding domain comprises a VH region comprising the amino acid sequence selected from the group consisting of SEQ ID NO: 155, SEQ ID NO: 165, SEQ ID NO: 175, SEQ ID NO: 285, SEQ ID NO: 295, SEQ ID NO: 305, and SEQ ID NO: 315.

7. The antibody construct according to claim 1, wherein the first binding domain comprises a VL region comprising the amino acid sequence selected from the group consisting of SEQ ID NO: 176, SEQ ID NO: 286, SEQ ID NO: 296, SEQ ID NO: 306, and SEQ ID NO: 316.

8. The antibody construct according to claim 1, wherein the first binding domain comprises a VH region and a VL region comprising a pair of amino acid sequences selected from the group consisting of SEQ ID NO: 175 and 176, SEQ ID NO: 285 and 286, SEQ ID NO: 295 and 296, SEQ ID NO: 305 and 306, and SEQ ID NO: 315 and 316.

9. The antibody construct according to claim 1, wherein the first binding domain comprises an amino acid sequence selected from the group consisting of SEQ ID NO: 177, SEQ ID NO: 287, SEQ ID NO: 297, SEQ ID NO: 307, and SEQ ID NO: 317.

10. The antibody construct according to claim 1, wherein the second binding domain binds to human and *Callithrix jacchus*, *Saguinus Oedipus* or *Saimiri sciureus* CD3 *Epsilon*.

11. The antibody construct according to claim 1 comprising an amino acid sequence selected from the group consisting of SEQ ID NO: 178, SEQ ID NO: 288, SEQ ID NO: 298, SEQ ID NO: 308, and SEQ ID NO: 318.

12. The antibody construct according to claim 1 comprising an amino acid sequence selected from the group consisting of SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, and SEQ ID NO: 425.

13. A pharmaceutical composition comprising the antibody construct according to claim 1.

14. A kit comprising the antibody construct according to claim 1 and a recipient.

* * * * *